(12) United States Patent
Hahn et al.

(10) Patent No.: US 6,897,301 B2
(45) Date of Patent: *May 24, 2005

(54) REFERENCE CLONES AND SEQUENCES FOR NON-SUBTYPE B ISOLATES OF HUMAN IMMUNODEFICIENCY VIRUS TYPE 1

(75) Inventors: Beatrice H. Hahn, Birmingham, AL (US); George M. Shaw, Birmingham, AL (US); Feng Gao, Hoover, AL (US)

(73) Assignee: The UAB Research Foundation, Birmingham, AL (US)

( * ) Notice: Subject to any disclaimer, the term of this patent is extended or adjusted under 35 U.S.C. 154(b) by 2 days.

This patent is subject to a terminal disclaimer.

(21) Appl. No.: 10/290,579

(22) Filed: Nov. 8, 2002

(65) Prior Publication Data

US 2003/0148266 A1 Aug. 7, 2003

Related U.S. Application Data

(62) Division of application No. 09/184,418, filed on Nov. 2, 1998, now Pat. No. 6,492,110.

(51) Int. Cl.[7] .............................................. C07H 21/04
(52) U.S. Cl. ....................... 536/23.72; 536/23.1; 435/5; 435/6; 435/91.2; 530/324; 530/350
(58) Field of Search ............................. 536/23.1, 23.72, 536/350, 324; 530/350, 324; 435/6, 91.2, 5

(56) References Cited

PUBLICATIONS

Cameron, 1997, Molec. Biol. 7, pp. 253–265.*
Niemann, 1997, Transg. Res. 7, pp. 73–75.*
Mullins (1990, Nature, vol. 344, 541–544).*
Hammer (1990, Cell, vol. 63, 1099–1112).*
Overbeek (1994, "Factors affecting transgenic animal production," Transgenic animal technology, pp. 96–98).*
Wall, 1996 Theriogenology, vol. 45, pp. 57–68.*
Houdebine, 1994, J. Biotech. vol. 34, pp. 269–287.*
Kappell, 1992, Current Opinions in Biotechnology, vol. 3, pp. 548–553.*
Mullins, 1989, EMBO J., vol. 8, pp. 4065–4072.*
Taurog, 1988, Jour. Immunol., vol. 141, pp. 4020–4023.*
Mullins (1996, J. Clin. Invest. vol. 98, pp. S37–S40.*

* cited by examiner

*Primary Examiner*—Lynette R.F. Smith
*Assistant Examiner*—Robert A. Zeman
(74) *Attorney, Agent, or Firm*—Benjamin Aaron Adler

(57) ABSTRACT

The nucleotide sequences of the genomes of eleven molecular clones for non-subtype B isolates of human immunodeficiency virus type 1 are disclosed. The invention relates to the nucleic acids and peptides encoded by and/or derived from these sequences and their use in diagnostic methods and as immunogens.

6 Claims, 69 Drawing Sheets

4701-5200

5201-5700

92RW009.6

93BR029.4

92NG083.2

92NG003.1

94CY032.3

| tat (second exon) | | frequency |
|---|---|---|
| CONSENSUS_A | P?PQTQG?.?TGPKESKKKVESKTETDRFD* (SEQ ID NO: 113) | 0/14 |
| CONSENSUS_B | P?SQPRGD.PTGPKESKKKVERETETDP?D* (SEQ ID NO: 114) | 4/52 |
| CONSENSUS_C | PLPQTRGD.PTGSEESKKKVESKTETDPFD* (SEQ ID NO: 115) | 0/11 |
| CONSENSUS_D | PSSQPRGD.PTGPKE*  (SEQ ID NO: 116) | 11/15 |
| ELI | ------.-----Q--E--T--* (SEQ ID NO: 117) | |
| Z2Z6 | ------.-----* (SEQ ID NO: 116) | |
| NDK | ---S--.-----K* (SEQ ID NO: 118) | |
| 92UG021.16 | ------.-----* (SEQ ID NO: 116) | |
| 92UG024.2 | ------.---EKQ------A-----C* (SEQ ID NO: 119) | |
| JY1 | ------.-----* (SEQ ID NO: 116) | |
| UG269A | ---N--.-----K* (SEQ ID NO: 120) | |
| UG274A2 | ------.-----* (SEQ ID NO: 116) | |
| SE365A2 | ---H--.-----* (SEQ ID NO: 121) | |
| 93ZR001.3 | -L----.-----Q--A-R--C* (SEQ ID NO: 122) | |
| UG266A2 | ------.-----Q--V----* (SEQ ID NO: 123) | |
| MAL | ---H--H.-----* (SEQ ID NO: 124) | |
| K124A2 | ---H---.Q---Q--* (SEQ ID NO: 125) | |
| 84ZR085.1 | ------.---Q--* (SEQ ID NO: 126) | |
| 94UG114.1 | ---N--.-----* (SEQ ID NO: 127) | |
| CONSENSUS_E | PLPIIRGN.PTDPKESKKEVASKAETDPCD* (SEQ ID NO: 128) | 0/9 |
| CONSENSUS_F | PISQARGN.PTGPKESKKEVESKAKTDPCA* (SEQ ID NO: 129) | 0/4 |
| CONSENSUS_G | PLPTTRGN.PTGPKESKKEV?SKTETDPFD* (SEQ ID NO: 130) | 0/8 |
| CONSENSUS_H | PLSRTHGD.PTGPKEQKKEVASKTETDP* (SEQ ID NO: 131) | 0/1 |

Vpu

| | | Frequency |
|---|---|---|
| CONSENSUS_A | M??L......EI?AIVGLVVALI?AIVVW.TIVGI | 0/13 |
| | (SEQ ID NO: 155) | |
| CONSENSUS_B | MQSL......QI?AIVALVVAAIIAIVVW.TIV?I | 0/26 |
| | (SEQ ID NO: 156) | |
| CONSENSUS_C | M?DLLAKVDYRL?VGALIVALIIAIVVW.TIAYI | 10/10 (SEQ ID NO: 157) |
| 92BR025.8 | -LE-IGRI----G-------V-I--.------- | (SEQ ID NO: 158) |
| C2220 | -V---------IVIV-F-------------- | (SEQ ID NO: 159) |
| SM145 | -LN---G----IAI--FS---------V--- | (SEQ ID NO: 160) |
| UG268 | -LN---G----IGI---LI------I-V--- | (SEQ ID NO: 161) |
| DJ259 | -I--P-----A--------------V--- | (SEQ ID NO: 162) |
| DJ373 | -I---------A-A-F-I-F----------- | (SEQ ID NO: 163) |
| SE364 | -V--------G------------I------- | (SEQ ID NO: 164) |
| 94IN476.104 | -VN--ER----G-------------L----L | (SEQ ID NO: 165) |
| 96ZM651.8 | -L---R-N--VG-----L------------- | (SEQ ID NO: 166) |
| 96ZM751.3 | -LN-E-R---IG----A-------A-.I-V-- | (SEQ ID NO: 167) |
| CONSENSUS_D | MQPL......?ILAIAALVVALIIAIVVW.TIVFI | 0/9 |
| | (SEQ ID NO: 168) | |
| CONSENSUS_F | MSYL......LAI?I?ALIVALIIAIVVW.TIAYI | 0/4 |
| | (SEQ ID NO: 169) | |
| CONSENSUS_G | MQ?L......EI?AI?GLVVAFIAAIVVW.SIV?I | 0/3 |
| | (SEQ ID NO: 170) | |
| CONSENSUS_H | MYIL......G.LGIGALVVTFIIAVIVW.TIVYI | 0/1 |
| | (SEQ ID NO: 171) | |

10% Divergence 4241-4640

4641-5040

10% Divergence 5071-5470

5471-5870

10% Divergence 5901-6300

6821-7220

10% Divergence

```
93BR020.1   ................CTGAAAGCGAAAGTAA.ACCAGAGAAGAACTCTCGA      35
92NG083.2   ATGAAAGCGAAAGTTAATAGGGACTC----A-------T...---------TT------      57
90CF056.1   .................T---T--T-.------A----------T------            36
92RW009.6   ..............A..-.-------------G-------G---T------            36
92NG003.1   TTGAAAGCGAAAGTTAACAGGGACTC-------------T...---------TT------    57
93BR029.4   ...........................-----------GA------G--CT----T--    36
94CY032.3   .TTGAAAGTGAAAGTTAATAGGACTC-------------T...---------TT------   56
96ZM651.8   ............--TG----------G--------G---T------                  35
96ZM751.3   ......................-------------G-------G---T------          36
94CY017.41  TTGAAAAGCGAAAGTAACAGGGACTC-------------T...------G--TT------    57
94IN476.104 ..............T----------------G-------G---T------              36

93BR020.1   CGCAGGACTCGGCTTGCTGAA.GTGCACACGGCAAGAGGCGAGA.GCGGCGACTGGTGAG    93
92NG083.2   ---------------------.--------A-------------.-----------------  115
90CF056.1   ---------------------.--------A-------------.-----------------   94
92RW009.6   ---G-----------------.---A----------------------------G-------   95
92NG003.1   ---------------------.-----G----.-A-----------.----------------  115
93BR029.4   ---------------------.---C--G--------G---------GG-------------   95
94CY032.3   ---------------------.-----G----.----A-------.----------------  114
96ZM651.8   ---------------------.-------T--------------.----------G-------   93
96ZM751.3   ---------------------.-------T--------------.----------G-------   94
94CY017.41  ---------------------.---G-----------------.---------GG-------  116
94IN476.104 ---------------------.-------T-A------------.--------GG-.-----   94
                                                              → GAG start
93BR020.1   TACGCC..AAAATT.....TGACTAGCAGAGG.CTAGAAGGAGAGAG|ATGGGTGCGAGAG   145
92NG083.2   ------....-T--TT..---------G---G-------------G-|---------------  168
90CF056.1   ------....-T--TGTTT--------G---G-------------|---------------   149
92RW009.6   ------...-T--TA.TT---------G---.-------------|---------------   151
92NG003.1   ------....-T--TT..T--------G---.-------------|---------------   169
93BR029.4   ------AA---TAAAATTTG-------G----.-------------|---------------   154
94CY032.3   ------....-T--TT..--------G----.-------------|---------------   168
96ZM651.8   ------...-----TTATT--------G----.-------------|---------------   149
96ZM751.3   ------....-T--TA.TT--------G---.-------------,-|--------------   149
94CY017.41  ------TA-T-T--T....-------------.-------------|---------------   171
94IN476.104 ------....-T--TTATT--------G----.-------------|---------------   150

93BR020.1   CGTCAGTATTAAGCGGGGGAAAATTAGATGCTTGGGAAAAAATTCGGTTAAGGCCGGGGG    205
92NG083.2   ------------------------T--------------------------------A----  228
90CF056.1   --------------C------------------G--------C-----------A----  209
92RW009.6   ------A--------A--C--------------------AA-----A---A----     211
92NG003.1   ---------------------A-----------------------G----A----      229
93BR029.4   ------A-----------G-------AAA-------------A---------A--A-    214
94CY032.3   -----------T------.-------A-----G-GG------------A----        228
96ZM651.8   ------A--------A----------AAA-----------A--C------A----     209
96ZM751.3   ------A--------A--C-------AA------G--A------A----           209
94CY017.41  -----A--------------------------G---------------A----        231
94IN476.104 -----A--------A--------------AGA-----------------A----       210

93BR020.1   G.AAAGAAAAATATAGACTAAAACATCTAGTATGGGCAAGCAGGG.AGCTAGAACGATT    263
92NG083.2   -.--G------G----A-----------A------------------.-A--G-GGA----  286
90CF056.1   -.---------G-------------------------------------.----G---A----  267
92RW009.6   -G--------C-----TGA-G-----C--------------------.----G--A----   270
92NG003.1   -.-------------A-G-----T-------------------.-A--G--GA----     287
93BR029.4   -.-C-T-----------T------A--------------------.------G-------    273
94CY032.3   -.------------G------------------------A-,--T-G---A----        286
96ZM651.8   -.-------CGC----TGA-------C--------------------,----G--A----   267
96ZM751.3   -.---A--GC-C----TGA-G-----CT-A-----------------,----G--A----   267
94CY017.41  -.---------G-------T-G---------------------------.----G--GAA---  289
94IN476.104 -.-------C-T----TGA-------CT-------------------,----G---A----  268

93BR020.1   TGCACTTGATCCAGGCCTTCTAGAAACATCAGAAGGCTGTCGAAAAATAATAGGACAGTT    323
92NG083.2   --------A-C-GT-A----T--------G-------T---GTGC-------GAA------   346
90CF056.1   --------A-C--C------T--------C-------------T-C-G-------A----A-  327
92RW009.6   --------A-C--T-A----T----G---C-------------AA-C-------GA-----C-  330
92NG003.1   --------A-C--T-A----CT---------A------T----AGC-------GA-----C-  347
93BR029.4   C---G--A----T------T----G-----------A----C-G-A----C-           333
94CY032.3   C-----A-C--T------T--------G-------A----A-C--T---G-A------    346
96ZM651.8   ---G---A-C--T------T--------------AA-C-------GAA----C-         327
96ZM751.3   --------A-C--T------T----G---------AA-C-------CA----C-        327
94CY017.41  CT-A--A-C--T------T--------C----G--A----A--C--------A-G----   349
94IN476.104 ---G---A-C--T------T----G--G-----C--A---AA-C----------AA----C-  328
```

Fig. 13A

```
93BR020.1    ACAACCATCCCTTCAGACAGGATCAGAAGAGCTCAAATCATTATATAATACAATAGCAGT    383
92NG083.2    G------G-T--CT--------A----G-----T-G--------T------G-----AC    406
90CF056.1    ---G---G-TA--A---------A-------A--T----- ....T----CT-G-------    387
92RW009.6    G------G-T---------------A----T--A--T-GG----------------G-----AC    390
92NG003.1    G--------T---C---------A----G---A-T----------T-------G-----AC    407
93BR029.4    -------G----A----G-----------A--T-G----------------G-----AC    393
94CY032.3    ----T--A-T--CA-A----------------A--T-G-----------------T--A--AC    406
96ZM651.8    -------G-T------    ----A-G--G--A-T-G--------C--C----G-----AC    387
96ZM751.3    -------G-T--C---------A----G--A-T-GG---------------G-----AC    387
94CY017.41   - -----G-T--C--A------A-------A--T-----------------G---T---    409
94IN476.104  ---T---G-T---A---------A----G--A--T-GG-------TC--C---G-----AC    388

93BR020.1    CCTCTATTATGTACATCAAAAGGTAGAGGTAAAAGACACCAAGGAGGCTTTAGAGAAGCT    443
92NG083.2    ------C-G-------------A-----------------A--A----CC----G-AG-    466
90CF056.1    -------GC--------G---AA----T--G------------------T----A-    447
92RW009.6    --------G----------A----T-----------------C-----C---A-    450
92NG003.1    --------G-----------G-A--------------------A--A----C-----G-AG-    467
93BR029.4    --------G-----------A----T-------------A----------A----A-    453
94CY032.3    -----GG-GC---------GAA----T---C------------A---------T--AA-    466
96ZM651.8    T------G-------G--GG----------CG---------A--C-----C-G-A-    447
96ZM751.3    T------G--------G-----A--A-----CG---------A--CC----C---A-    447
94CY017.41   ------C-GG----------G-----T-----------------A--C---T--AA-    469
94IN476.104  T------G- -----GC-GG--A---------CG-----------A--C-----C---A-    448

93BR020.1    AGAGGAAGAACAAAACAAAGGTCGGCAAAAGACACAGCAA..............GCGACT    489
92NG083.2    G--AA--AT------G--CA---A----G-A-T------G........GCA....-A-AG    515
90CF056.1    -------AT---------A---A----A---------------........GCA....-AG--    496
92RW009.6    ---------A---A------A--------------G.......GCAGAA--AG--    502
92NG003.1    G--AA--AT------G--CA---A--- G A ------A-G.......GCA....-A-TG    516
93BR029.4    ---------G-------A--A-----G---------GCA....-AG--    501
94CY032.3    ---------AT-----GT--GA-CAA-----------G........GCA....-AG--    515
96ZM651.8    --------------AT--A------A-T------AAAACACAGCAA.----G--    505
96ZM751.3    ---------------A---AA-----A-T---AA--,......ACAGAA-·----    499
94CY017.41   ---------------A---A---G--A------------T........GCA....-AG--    512
94IN476.104  ----------------A---A------A-T-----G........GCAAAA-A-G--    500

93BR020.1    GCTGAAAAAGG.........GGTCAGTCAAAATTACCCTATAGTACAGAATCTTCAGGGA    540
92NG083.2    AA----GG--AACAGTAACCCA-----C---------T--------G------GCA--A--G    575
90CF056.1    -A-A-GG--AAAGACAACAA---------------T---------GC---A--G    556
92RW009.6    -ACA--GG-A........AA------------------G--A---GCA--A--G    553
92NG003.1    -G-A--GG-AACAGCAGCCA--T--C--------T--------G------GCA--A--G    576
93BR029.4    AACAC-GG-AACAACAGCCA-----C--------T--------G-----C-------G    561
94CY032.3    --C-C-GG---TAGCAGCAAT-----C----------G--A---GCA--A--G    575
96ZM651.8    -AC-G---........----------T--------G-----C--A--G    553
96ZM751.3    -GC-G---...............---------T--------G-----C--A--G    547
94CY017.41   -ACAC-GGGAACAGCAG.....----------T--C-----G--A---GCA--A--G    566
94IN476.104  -AC-G---........-----------T--------G--A-----C--A--G    548

93BR020.1    CAAATGGTACACCAGTCTTTATCACCTAGAACTTTAAATGCATGGGTAAAGGTGATAGAA    600
92NG083.2    ------A----T---G-CA----------G-----G----G---------A--AG-----    635
90CF056.1    --G-----------G-CA----------G--C-----------------A--AG-----    616
92RW009.6    ---------G-CA------------G-----G--------A--A-----G    613
92NG003.1    ---G---------C-CA-----------G-----------------A--AG-----    636
93BR029.4    --------------G-CA-----------------------A--AG-----    621
94CY032.3    -----------T---AGCA-T---------G--------------A--A------    635
96ZM651.8    ------------AAAC-----------------G-----------A--A-----    613
96ZM751.3    ----------G--A---------------G----------A--A-----G    607
94CY017.41   -----------G--A---------G--G--G-----C-----C--A--AG-----    626
94IN476.104  ----------------C-CC-----------------G-----G--------A--A-----G    608

93BR020.1    GAGAAGGCTTTTAGTCCAGAAGTAATACCCATGTTTTCAGCATTATCAGAAGGGGCCACT    660
92NG083.2    --A-----C--C-------------------------------G--A-----C    695
90CF056.1    --A-----------C---------------------------------A-----C    676
92RW009.6    -------C-A--G---------A---------------A-----C    673
92NG003.1    --A----AAC--C-----------------A--------------A-----C    696
93BR029.4    ----------C----------------------------A-----C    681
94CY032.3    --A--------C--C-----  ---------C-------------G--A-----C    695
96ZM651.8    --A--A-----C-----G--------A----------------A-----C    673
96ZM751.3    ------G---C-AC-----G--------A--------------A-----C    667
94CY017.41   --A--------C--C---------T----A---------------A-----C    686
94IN476.104  --------------C-----G-----------CA---------------A-----C    668
```

Fig. 13B

```
93BR020.1    CCACAAGATTTAAACACCATGTTAAATACAGTGGGGGGACATCAAGCAGCCATGCAAATG    720
92NG083.2    ---------------T-----C---------------G---------------T--------    755
90CF056.1    --------C-----TG-T---C-----------------------------------G---    736
92RW009.6    ------------------C-------------------------------------------    733
92NG003.1    -----------G--T------C----C--C---------G-------------T--------    756
93BR029.4    --------------------C----C------------------------------T-----    741
94CY032.3    -----------G----TG---C------T----------------C--G-----A-------    755
96ZM651.8    ----------------------------------------------------------    733
96ZM751.3    ---------C----------------------------------------------------    727
94CY017.41   ------C------T--T---C----C------------------------T--------    746
94IN476.104  --CTCT--------------------------------------------------    728

93BR020.1    TTAAAAGACACCATCAATGAGGAGGCTGCAGAATGGGACAGATTACATCCAACACAGGCA    780
92NG083.2    C----G--T--T--------T--A---------G--------GA--------CAG------    815
90CF056.1    --------T--A----------A-------------------GG---------GTG--T---    796
92RW009.6    C------T--A---------------------G-----T--GG-------GTG------    793
92NG003.1    C-------TT-T--T-----A--A----------G-----T--GC---------CA------    816
93BR029.4    ---------A-----------A-----------------G----------GTG--T---    801
94CY032.3    --------T---------------A--------C-------GAC------GT---T---    815
96ZM651.8    --------T--T----------------A-----------T----------GTG--T---    793
96ZM751.3    --------T-----------A-----------T--G------GT---T---    787
94CY017.41   --------T--------------A-----------------GG-------GT---T---    806
94IN476.104  --------T---------C-----------G--------T------------GT---T---    788

93BR020.1    GGACCCATCCCCCCAGGTCAGATAAGGGAACCTAGGGGAAGTGATATAGCTGGAACTACT    840
92NG083.2    --G--T--T--A-----C--A-----A--G-----T--------------A--------    875
90CF056.1    --G--T--T--A-----C--A--G--A-----A--------C--------A--------    856
92RW009.6    --G--TG-TG-G-----C--------A-----A-----------C-----A--------    853
92NG003.1    -----T--T--A----C------A-----A----------A--------    876
93BR029.4    -----T-----A-----C-----G-----------------------A--------    861
94CY032.3    --G--T--T--A-----C-----G--A-----A--------------A--------    875
96ZM651.8    --G--T--TG-A-----C--A--G--A-----A--------------A--------    853
96ZM751.3    --G--T--TG-A-----C--A-----A--------------C----A--------    847
94CY017.41   --G--T--T--A-----C-----G--A-----A--------C--------A--------    866
94IN476.104  --G--T-AT--A-----C-----G--A-----A--------------A--------    848

93BR020.1    AGTACCCTTCAGGAACAAATACAATGGATGACAGGCAACCCACCTGTCCCAGTGGGAGAA    900
92NG083.2    --------G----------AG---------CA----------A-------------    935
90CF056.1    --------G-----------GC------------T---G--A-------------C    916
92RW009.6    -------------------GC---------AAT---------A-T-------------    913
92NG003.1    --------G-----------AC---------CA----------A-------------    936
93BR029.4    ------------------A---------------------    921
94CY032.3    -----------A---------GG----------A----------------------    935
96ZM651.8    -------C--A-----G--GC---------A-T--T--C---A-T-----------C    913
96ZM751.3    G-------------------GC---------AAT---------A-T-----------C    907
94CY017.41   -------------------GGT-------CA--G-T-----CA-------------    926
94IN476.104  -------------------GC----------T----------A-T----------C    908

93BR020.1    ATGTATAAAAGATGGATCATCCTAGGATTAAATAAAATAGTAAGAATGTATAGCCCTGTC    960
92NG083.2    --C-------------A-----G------------------G-----------------    995
90CF056.1    --C-------------A-----G------------------G--------T------    976
92RW009.6    --T-------------A--T-G--G------------------------------    973
92NG003.1    --T-------------A--T-G--G------------G-----------------    996
93BR029.4    --T-----------------------------------------------AC-    981
94CY032.3    --C-------------A--T-G--G-----------------C--------CA-T    995
96ZM651.8    --C-------------A--T-G--G-----------------------------    973
96ZM751.3    --C-------------A--T-G--G-----------------C--------    967
94CY017.41   --T-------------A-----G-----------------------------    986
94IN476.104  --C-------------A--T-G--G-----------------------------    968

93BR020.1    GGCATTTTGGACATAAGACAAGGGCCAAAAGAACCCTTTAGAGACTATGTAGACAGGTTC    1020
92NG083.2    A---------------------------------T--------T------    1055
90CF056.1    A----C-----A-----------------------------------T    1036
92RW009.6    A----A--------A------------G-----T---------C------    1033
92NG003.1    A-T-----A-------A------------------C-----T-----G--T------    1056
93BR029.4    A-----C---G----------A-----G----------------------TC-A--T    1041
94CY032.3    A-----C-----------------A-----------C-----T--------T------    1055
96ZM651.8    A-----------A------------G-----------------C-----    1033
96ZM751.3    A-----C---------A------A-----G----------G---------TC-----    1027
94CY017.41   A---------------------------------T----G--T------    1046
94IN476.104  A-----------------G----------------------C-----    1028
```

Fig. 13C

```
93BR020.1    TTTAAAACCCTAAGAGCTGAGCAAGCTACACAGGAAGTAAAGGGTTGGATGACAGACACC    1080
92NG083.2    -------TT-G-------------------------A-----------------------    1115
90CF056.1    -------TT------------------C--------T--G---AA-------------A---    1096
92RW009.6    --------T-------C--A------T----A--T-----AAA-------------T---    1093
92NG003.1    -------TT-G----------------C--------G-----AAAC--------------    1116
93BR029.4    -A--------T--------A-------A--T-------T----AAA-------------A---    1101
94CY032.3    -----TGT  C-----A--A-------C-----G--G--AAA--------------A---    1115
96ZM651.8    --C-----TT---------A--G--------A---------AAA---------------    1093
96ZM751.3    -------TT----------A-----------A--T-----AA------------------    1086
94CY017.41   -------T------------------C--------G-----AAAC--------G------    1106
94IN476.104  -------TT----------A----------A------A----------------------    1088

93BR020.1    TTGTTGGTCCAAAATGCGAACCCAGATTGTAAGACCATTTTAAAAGCATTGGGACCAGGG    1140
92NG083.2    -------T----------------A-----C----G------A--------A        1175
90CF056.1    ----------------A--T--------C-----T--A----G------A----A----    1156
92RW009.6    -----A-----------------------------G-----------A--G------    1153
92NG003.1    --------------------------------CC---G------A---G----A      1176
93BR029.4    -------------------C--A-----------------------------CA      1161
94CY032.3    C--C-------------T-----C------T----C----------A---A-----    1175
96ZM651.8    ----------------A-----------C----------------A---------    1153
96ZM751.3    --------T--------------------------GG-----A----------    1146
94CY017.41   ---C------------------------GAT----C--G-G-----A---------    1166
94IN476.104  ---------------A----------------------G-----A---------    1148

93BR020.1    GCTACACTAGAGGAAATGATGACAGCATGTCAGGGAGTGGGAGGACCTAGCCATAAGGCA    1200
92NG083.2    --------A-----------------------------------C--------A---    1235
90CF056.1    ---T-A----A---------------------------------T-----A---    1216
92RW009.6    ---T--T----A--------------C-------------CG-------A---    1213
92NG003.1    ----------A--------T-------A--------------C-----C--A---    1236
93BR029.4    ----------A-------------------------G-----CG-------A---    1221
94CY032.3    ------T----A------------------------------C--------A---    1235
96ZM651.8    ------T----A-------------A---------------------C--A---    1213
96ZM751.3    ------T----A------------------G-----G----C--A-'--    1206
94CY017.41   --CT--T----A---------------------C--------A---    1226
94IN476.104  ---T--T----A-------G----------A----------------C--A---    1208

93BR020.1    AGAGTTTTGGCTGAGGCAATGAGCCAAGCAACAAAT......ACAGCT...ATAATGATG    1251
92NG083.2    ----------A-----------------G---T--GG-GCAGCAG----AGCC--------    1295
90CF056.1    ----------------------------T--------...ACA-ATA-AGCC---------    1273
92RW009.6    --G-----------A-----------T-CA-......CAAC--AAC...----------    1264
92NG003.1    ----------A---------------GG------GG-...ACAT------AGCC------    1293
93BR029.4    ----------A--A-------------T-------...TCAGGTA-C...---------    1275
94CY032.3    ----------A---------------G---T------.GCAG----AGCC---------    1292
96ZM651.8    -----G---------------------A---AT-G-.....GTA-A-....---C-----    1264
96ZM751.3    --------------A--------------T--AC-......ACA-A-...--------    1257
94CY017.41   --G----------A-------------T-T-CA--G-...ACA-ATA-AAAC--------    1283
94IN476.104  -----G----------------------T--CAT-G.........-A-....---------    1256

93BR020.1    CAGAAAAGTAACTTTAAGGGCCAAAGAAGAATTGTTAAATGCTTTAATTGTGGCAAAGAA    1311
92NG083.2    --------C--T---------CG---------A----G--T--C--C--------G---    1355
90CF056.1    ------G-C-------------------A-T--------------C--C----------G    1333
92RW009.6    ----G-G-C--T-----------G---------A----G--T--C--C--------G---    1324
92NG003.1    --------AC--T---------CG------GG-A----G--T--C--C--------G---    1353
93BR029.4    ----G-G-C--T----G-AA--------AG-C-A----G--T--C---------------    1335
94CY032.3    --------C--A--------------C-A----G--T--C--C--------G---    1352
96ZM651.8    --------C--T-----A--AA-T-A------G-------T-----C-----T--G---    1324
96ZM751.3    ------C--T-------A----CT-A----------------T--C--C-------GG---    1317
94CY017.41   ----G-G-C--T----G---T----A-----...A----G--T--C--C--------G---    1340
94IN476.104  ----G-G-C--T-----A----CT-A-------------------C--C--------G---    1316

93BR020.1    GGACACATAGCCAAAAATTGCAGGGCCCCTAGAAAAAAGGGCTGTTGGAAGTGTGGAAGA    1371
92NG083.2    -----TC------G---------------G----------------A-------AG    1415
90CF056.1    --------C------G---------------G----------------A---------    1393
92RW009.6    ------C------G---------------G----------------A-------AG    1384
92NG003.1    -----TC------G---------------G-----A------A-------AG    1413
93BR029.4    --G---------------------------G---------C-----A-------AG    1395
94CY032.3    -----TC------G---------------G---------C-----A-------AG    1412
96ZM651.8    --G---------G---------------G----------------A-------AG    1384
96ZM751.3    --G--T-------GG----------T---G-G-----A----------A-------AG    1377
94CY017.41   --C------G---------------G----------C-----A-------AG    1400
94IN476.104  --G----------G---------------GA----------A-----GCA-    1376
```

Fig. 13D

```
                                                        → POL start
93BR020.1    GAGGGACACCAAATGAAGGACTGCACTGAGAGACAGGCTAA TTTTTTAGGGAAAATTTGG   1431
92NG083.2    -------T---------A--A-----G--A--G--------|-------------------   1475
90CF056.1    --A-----T--G-----A-------A---------------|-------------------   1453
92RW009.6    ----------------A------------------------|-------------------   1444
92NG003.1    -------T---------A--------A--------------|-------------------   1473
93BR029.4    --A--------G-----A--T--T-----------------|--------------C---   1455
94CY032.3    -------T---------A-----------------------|---------G---G----   1472
96ZM651.8    -----------------A-----T---------G-------|-------------------   1444
96ZM751.3    -A---------------A-----T-----------------|-------------------   1437
94CY017.41   --A-----T--------A--T--------------------|-------------------   1460
94IN476.104  --A--------------A-----T--------G--------|-------------------   1436

93BR020.1    CCTTCCAACAAGGGGAGGCCCGGAAACTTCATCCAGAACAGG..................   1473
92NG083.2    ---------------------A-------TC------------..................   1517
90CF056.1    ------G---A---------A-----T--TC-----G------..................   1495
92RW009.6    ------------------A-----T--TCC-----G---A.....................   1486
92NG003.1    ------------------A--G-T--TC-T-------------..................   1515
93BR029.4    -----C----------A---A--G-T---C-T----G---A...................   1497
94CY032.3    ------G---A---------A------T-TC-T----------..................   1514
96ZM651.8    -----C----------A---A--G-T---C-T-----------..................   1486
96ZM751.3    -----C-G-----------G--G-----C-T--------ACCAGAGCCAACAGCCCCA    1497
94CY017.41   ---------A----------A-----T--TCCT----G--A...................   1502
94IN476.104  -----C--------------A--G-T--C-T--A---------..................   1478

93BR020.1    CCAGAGCCGTCAGCCCCGCCAGCAGAGAGCTTCAGGTTCGGGGAGGAGACAACCCCATCT   1533
92NG083.2    A------AA-------A----------------G-A------A--------T-G-----C--C    1577
90CF056.1    ----A--AA-------A---------------G-------A--------TG-----C---    1555
92RW009.6    -TG----AA-------A-------A---TG-AA-G-----A----T-G--T-TC--    1546
92NG003.1    --------AA-------A--C-----------G---------A--------T-G-----T--C    1575
93BR029.4    --------AA-------A----------------T-------A---GT---AA-TC-C    1557
94CY032.3    --------AA---------C--G--AT----AGA-AGGAAA----------T-C---    1574
96ZM651.8    --------AA-------A-----------------A---...----------CG--    1543
96ZM751.3    ----CT--AA-------A-----------------A---...---------TG-C    1554
94CY017.41   A-------AA-------A----------A---G--AA-G-----A----T-C--C    1562
94IN476.104  --------AA-------A-----------------AA--...---------CG--    1535

93BR020.1    CC...GAAGCAGGAGCAGAAAGACGAGGGACTGTACCCTCCCTTAGCTTCCCTCAAATCA   1590
92NG083.2    --..---CA--G--GA---AG--A...TA------A--------------    1631
90CF056.1    --GAA-C--G--C---T--G--A---A--C.....---------------G----    1609
92RW009.6    -T..---A---------------AG--A..........--T---AT--------    1594
92NG003.1    -T...---------C--GG--AA---A-TCA...-----A---A-C----------    1629
93BR029.4    T-TCA---A-------C--T-----A---AGA--...TA---T--G---------G----    1614
94CY032.3    -T.........A-C--GG--A--A---A...TA---T---A----------    1628
96ZM651.8    --..........-TC-------AG--A......G-----A----------    1591
96ZM751.3    --...--G-----------------A-...........----A--G----------    1602
94CY017.41   -T..........A-T-G-CAC-AG--A--CA---AA---TGC-AT---------    1619
94IN476.104  --...-------TC------AG--A-..........---A-----------    1583
                                          GAG end ←
93BR020.1    CTCTTTGGCAACGACCCCTAGTCACAATAA GAGTAGGGGGACAGCTAAAGGAAGCTCTAT   1650
92NG083.2    ----------G---------------G---|A-A----------------TA-----C----   1691
90CF056.1    ----------G-----T--T-----G---|A-A-----A-------T---G----------   1669
92RW009.6    -----------------T------G----|A-A-----A--T-------GA----------   1654
92NG003.1    -----------------T-----G-----|--A----------------TA----------   1689
93BR029.4    ----------------C-----G------|AGA-------G--A----------C----   1674
94CY032.3    ----------G------T------------|A-C----------A---G---G-----T-   1688
96ZM651.8    ----------G-------T---T-------|AG-------C--AA-------G-----C-   1651
96ZM751.3    ----------G-------T--T--------|A---------T---A------G-----C-   1662
94CY017.41   ----------G-------T--T---G----|AGA---A------------A----------   1679
94IN476.104  ----------G-------T--T--------|A----------C--A-------------C-   1643

93BR020.1    TAGATACAGGAGCAGATGATACAGTATTAGAAGACGTAAATTTGCCAGGAAAATGGAAAC   1710
92NG083.2    ----C---------C---------------GAA--------A----------------   1751
90CF056.1    -----------------------------GA---------G-----------------   1729
92RW009.6    ------------------------------AA--------------------------   1714
92NG003.1    ----C------------------------C-AA--------A----------------   1749
93BR029.4    -----C-----------------------AA--------A------G--------   1748
94CY032.3    ------------------------------AA-------------G-          1748
96ZM651.8    ----C-G--------G---------------AA--------C-------------   1711
96ZM751.3    -G----------------------------AA--------------------------   1722
94CY017.41   ----------------------G-------AA--GC-----------G--------   1739
94IN476.104  ----C-------------------------AA--GC-----------G--------   1703
```

Fig. 13E

```
93BR020.1    CAAAAATGATAGGGGGAATTGGAGGTTTTATCAAAGTAAAACAGTATGATAGCATACTCA   1770
92NG083.2    ------------------------------------------G----------CAA----T-   1811
90CF056.1    ------------------------------------------G---------GCAAG--GC--  1789
92RW009.6    -----------------------------------G-----------------CAA----T-   1774
92NG003.1    ------------------A----------------------------------CAA----T-   1809
93BR029.4    ------------------------------------------G----------CAA----C--  1794
94CY032.3    ---------------C--------------------------G---A------CAG----CT-   1808
96ZM651.8    --------A----------C------G------G---A------CAA----CT-          1771
96ZM751.3    ---------A-----------------------G-----------CAA----T-           1782
94CY017.41   ------------------------------------------G---A------CAG---GCT-  1799
94IN476.104  ---------A--------------------------------G----------CAA----T-   1763

93BR020.1    TAGAAATTTGTGGACACAGAGCTATAGGTACAGTGTTAGTAGGACCTACGCCTGTCAACA   1830
92NG083.2    --------G-----A-A-AG---------G-----A--------------A---A-T----   1871
90CF056.1    -------C-----A-A-AG----------------A-----------------A--------T-  1849
92RW009.6    -------------A-A-AG----------------A-------------AT---------   1834
92NG003.1    --------GAA--GA-A-AG---------G-----AC---------------A---A------  1869
93BR029.4    --------------GT-A-----------------A-----------------A---------  1854
94CY032.3    ------------A-A-AG--C------C-------------------------A---------  1868
96ZM651.8    -G----------A-A-AG-----------------A-----------------A---------  1831
96ZM751.3    ------------A-A-AG-----------------A-----------------A---------  1842
94CY017.41   ------------A-A--G--C------C-----------------------C-----------  1859
94IN476.104  ------------A-A-AG-----------------A-----------------A---------  1823

93BR020.1    TAATTGGAAGAAATATGTTGACCCAGATTGGTTGTACTTTACATTTTCCAATTAGTCCTA   1890
92NG083.2    --------G-----------T------------A-C---------A-------           1931
90CF056.1    ----------G-----A-----T--A---------C--C---A---                  1909
92RW009.6    ----------------------------------A-C---------                  1894
92NG003.1    --------G-----------T--A-----------A---------                  1929
93BR029.4    ------------C-----T-----C--C------A------C----                  1914
94CY032.3    -------C---C--------T---C----------A---------                  1928
96ZM651.8    ---------------T---C----A--C--AC--A-------------,--             1891
96ZM751.3    --------G--------------C----C--C--AC--A------                  1902
94CY017.41   ----C--------------GTT---C---------A---------C----              1919
94IN476.104  ---------G----------T-----A--C----C--A---------C--C-           1883

93BR020.1    TTGAGACTGTACCAGTAAAATTGAAGCCAGGAATGGATGGCCCAAAGGTTAAACAATGGC   1950
92NG083.2    ----A------------------A----------------------G-------------   1991
90CF056.1    ----A------------------A------------------------------------   1969
92RW009.6    ----------------GC---A--------------------------------------   1954
92NG003.1    -----------------------A--A----------A----------------------   1989
93BR029.4    ----A------------------A----------------------G-------------   1974
94CY032.3    -------------------------A----------------------------------   1988
96ZM651.8    ----A------------------A------------------------------------   1951
96ZM751.3    ----A------------------A---------------------G---C----------   1962
94CY017.41   ----A------------------A--------------T---------------------   1979
94IN476.104  ----A------------------A--------------------------------G--?-   1943

93BR020.1    CATTGACAGAAGAAAAAATAAAAGCATTAACAGAAATATGTATGGAAATGGAAAAGGAAG   2010
92NG083.2    -------------G---------------T----AA--C----------           2051
90CF056.1    ----------------------G-----T----CA--G--------A----              2029
92RW009.6    ----------------------G-----T----CA----------A--G-              2014
92NG003.1    -------------G---------------T----CA--T--------                  2049
93BR029.4    -------------------------------------CA--C----A----              2034
94CY032.3    ------------------C------G-------CA--C--------                  2048
96ZM651.8    -------------G----------T------C---T---GAA--------G------       2011
96ZM751.3    ------------------------------C---T---GAA-----------             2022
94CY017.41   ------------------------------C----AA---------                  2039
94IN476.104  -------------G---------------T----AA--------G------             2003

93BR020.1    GAAAAATTTCAAAAATTGGGCCTGAAAATCCATACAATACTCCAGTATTTGCCATAAAGA   2070
92NG083.2    ----------------------T--C-------A----C----------A-              2111
90CF056.1    -----C----G---A---------G----------GC------A--------------A-    2089
92RW009.6    -----C------C-----------------T--C-------A--------------A-      2074
92NG003.1    ---------------A------------C-----A--------------               2109
93BR029.4    -----------C----------------------------------                  2094
94CY032.3    -C--G----------------------------A-------T------                2108
96ZM651.8    -------A-------------------T--C--------------A-                 2071
96ZM751.3    -------A----------C-----G-------T--C-------------A-             2082
94CY017.41   -----------------------------C--------G-----T------             2099
94IN476.104  -------A--------------------T--C-----------------A-             2063
```

Fig. 13F

```
93BR020.1   AAAAAGACAGTACTAAATGGAGGAAATTAGTAGATTTCAGAGAACTTAATAAAAGAACTC   2130
92NG083.2   ------------------------A-----G-----------------------------   2171
90CF056.1   -G--G--T--------------A-------G---------------C-------------   2149
92RW009.6   -G--G-----------G-----A----------------G-----C--C-----------   2134
92NG003.1   ------------------A--G--G--------------G--C-----------------   2169
93BR029.4   ------T-----------A-----------------------------G-------     2154
94CY032.3   ------C-------A-----------------------------C---------------   2168
96ZM651.8   -G--G-----------G---C-A-----------------G-----C-------       2131
96ZM751.3   -G--G-----------G-----A-----------------G-----C-------       2142
94CY017.41  ------C-------A----------------T--------------C---G-------   2159
94IN476.104 GG--G-----------G-----A----------------G--G--C-------         2123

93BR020.1   AAGATTTTTGGGAGGTTCAATTAGGAATACCGGCATCCAGCAGGGTTAAAAAAGAAAAAGT   2190
92NG083.2   ----C--C------C----------T--C--C-G-----------------GA-         2231
90CF056.1   ----C--C-----A-----G---------A--C--------------------A-        2209
92RW009.6   ----C--------A--C--------G-----A--C-----------G--------A-      2194
92NG003.1   ----C--C------C--------C----T----C--G--------------GA-         2229
93BR029.4   ----C--C-----A-----G-----G---A--C--------------G--------A-    2214
94CY032.3   -G--C--C-----A-----G-----------C--------------G--------A-     2228
96ZM651.8   ----C--------A-----------------A--C------------------A-        2191
96ZM751.3   -G--C--------A-----------------A--C-G-----------------         2202
94CY017.41  ----C--C-----A-----G---------A-----------A------------AG      2219
94IN476.104 ----C--------A---------------A--C---------T-----------A-      2183

93BR020.1   CAGTAACAGTACTGGATGTGGGGGATGCATATTTTTCAGTTCCCTTAGATAAGGATTTCA   2250
92NG083.2   -------G------A---------A--------C-----------------A--C--T-   2291
90CF056.1   ------T------------------------------C--T------A--A----      2269
92RW009.6   ----G------------------------------C--C---------T-----G--AGC---- 2254
92NG003.1   --------A-----------------------A------G-AA-C--T-            2289
93BR029.4   --------------T---------------------A---------A--C----        2274
94CY032.3   ------T-------------------------------------CCA--G----         2288
96ZM651.8   ----G----------------------------------T------G-AAGC          2251
96ZM751.3   ----G-----------------G----------------T------G-A-GC---       2262
94CY017.41  -------------T--------C-----------C---------C--G-A--C----     2279
94IN476.104 ----G-------------------------------------T------G-A-GC---G   2243

93BR020.1   GGAAGTACACTGCATCCACCATACCTAGTACCAACAATGAGACACCAGGAGTTAGGTACC   2310
92NG083.2   -A-----T-------TT--T----------TA--T-------------GA----A--T-   2351
90CF056.1   -A-----T-------T---------------TA-------------------GA----A--T-   2329
92RW009.6   ----A-----T-------------------A---------A-------T-            2314
92NG003.1   -A-----T--A----T---T----------TA--T-------------GA----A--T-   2349
93BR029.4   -------T-------TT-------------A---------A---------GC----A--T-    2334
94CY032.3   ----------------T-----------------------A----A--T-            2348
96ZM651.8   ----A--T-------T--------------A---------A---------GA----A--T-   2311
96ZM751.3   ----A--T-------T--------------TA--------A-----T--GA----A--T-   2322
94CY017.41  -A--A--T-------T--------------------------------------T-      2339
94IN476.104 ----A--T-------T--------------TA--------A---------GA----A--T-   2303

93BR020.1   AGTACAATGTGCTTCCACAAGGATGGAAAGGATCACCAGCAATATTCCAATATAGCATGA   2370
92NG083.2   -A------------------G---------------------------T--GAG--------   2411
90CF056.1   ---T----------------G-----------------------------GAG--------   2389
92RW009.6   -A--T---------------G-----------------------------A----T----   2374
92NG003.1   ----------------G---------------------------------T--GAG--------   2409
93BR029.4   ------------------G--G----------------------------AG--------   2394
94CY032.3   ------------------G--C----------------------------G--------   2408
96ZM651.8   -A--T---------------G-----------------------------GAG--------   2371
96ZM751.3   -A--T---------------G--------------T--------------GAG--------   2382
94CY017.41  --------A-----------G-----------------------------GAG--------   2399
94IN476.104 -A--T---------------G-----------------------------GAG--------   2363

93BR020.1   CAAAAATCTTAGATCCCTTTAGAGCAAAAAATCCAGACATAGTTATCTACCAATACATGG   2430
92NG083.2   -------T-----G--T-C----A----------A--G--G-----------          2471
90CF056.1   ------------CG--------A-C------T--A--G----T-----              2449
92RW009.6   ------------G--------G---C----C-A-----A------G-----T----T----   2434
92NG003.1   -------------A---------A--G--------A-----G----T--G-------   2469
93BR029.4   -----------G--T------AA-C-------------------T-----           2454
94CY032.3   ------------G----------TTC-----C------A--------C--A--------T----   2468
96ZM651.8   ------------G-----C--G--C--------------C-----T----T----     2431
96ZM751.3   T-----------G--------GA--C----C-----A-----------T----T----   2442
94CY017.41  ----G-------G---------T----G---A----AT--A-C--------------   2459
94IN476.104 ------------G--------G---CG-------A-A-----C-----T-----T----   2423
```

Fig. 13G

```
93BR020.1    ATGATTTGTATGTAGGGTCTGACTTAGAAATAGGACAGCATAGAACAAAAATAGAAGAGT    2490
92NG083.2    --------A--------A----------------G----------G----------G----    2531
90CF056.1    ----------------A----------------G--A------G----------G----    2509
92RW009.6    ----C-----C   ---A----------------G--A------G----------G----    2494
92NG003.1    ------A---------A----------------C---G----------G-------G--A-   2529
93BR029.4    ----------------A----------------G--------------T--G----G--A-   2514
94CY032.3    ------------------------------------G--A------G---------------C   2528
96ZM651.8    ----CC----------A-----------------G--A------G------------------   2491
96ZM751.3    ----C-----------A-----T----------G--A--C---G----------G----   2502
94CY017.41   ----C-----------A-----T--------A-C---------GT---------G--A-   2519
94IN476.104  ----C-------------------------------G--T------G----------G----   2483

93BR020.1    TAAGAGAACATCTACTGAAATGGGGATTAACTACACCAGACAAAAAACATCAAAAAGAAC    2550
92NG083.2    --------------------------G--C----------T----------G-------   2591
90CF056.1    ------CT---T-GT-------------T--C-------------------G-------   2569
92RW009.6    ---------T-A--G---------T--C------------T----------G-------   2554
92NG003.1    -----A-T---------G---------T--C----------T---------G-------   2589
93BR029.4    -G---C-G---T-GT---GG--------T--C-------------------G-------   2574
94CY032.3    ------G-----T---G---------C--C---------------------G-------   2588
96ZM651.8    --------------T-A--G--------T--C----------G--------G-------   2551
96ZM751.3    --------C---T--G----------T-----------G--G-----G------G-   2562
94CY017.41   ----G CT--CT--T-------------TTA--------------------G-------   2579
94IN476.104  ----C--------T-A--G---------C--C-------T--G--------G-------   2543

93BR020.1    CCCCATTCCTTTGGATGGGGTATGAACTCCATCCTGATAAATGGACAGTGCAGCCTATAC    2610
92NG083.2    -T-------------A-----G----------C---------G--A--A--------   2651
90CF056.1    ------T--------A----------------C---------A--A--G--A      2629
92RW009.6    -T-----T-----------------T-------C---------A--A--------   2614
92NG003.1    -T-----T--C-----A-----G----------C--------G--A--A------   2649
93BR029.4    -T---------------T-------------------------A--------G   2634
94CY032.3    ------T---------------------------C------------------   2648
96ZM651.8    ------T---------------------------C-------A----------   2611
96ZM751.3    ------T---------------------------C-------A--------A   2622
94CY017.41   -T---------------A----G--T-------C--------C--------A   2639
94IN476.104  ------T---------------------------C-------A--------A   2603

93BR020.1    AATTGCCAGACAAGGACAGCTGGACTGTCAATGATATACAGAAGTTAGTAGGAAAACTAA    2670
92NG083.2    -GC------A-----AGAT-----------------A-------G----------   2711
90CF056.1    --C------A--A----------------------------G----------   2689
92RW009.6    -GC------A-----T-------------------------G-----T---   2674
92NG003.1    -GC-----A----A--A----------------A--A----G----------   2709
93BR029.4    TGC-----A--A----------C------C----------G-----T-G-   2694
94CY032.3    --CC-G---A------T--------C----C----------G---------   2708
96ZM651.8    -GC--G----A--A--T-------T----------------G-----T---   2671
96ZM751.3    -GC------A-----G------------------------G-----T---   2682
94CY017.41   -GC------A--A--------------------A-------G---T---   2699
94IN476.104  -GC------A-----T------------------------G-----T---   2663

93BR020.1    ATTGGGCAAGTCAGATTTATCCAGGGATTAAAGTAAAACAATTATGTAAACTCCTTAGGG    2730
92NG083.2    -----------------------------G--CC-----G----------   2771
90CF056.1    ---------------AAT---------G---C-----------------   2749
92RW009.6    -C-------------C-----G--------GG-----G----------   2734
92NG003.1    ------------------------------G---C---------------   2769
93BR029.4    ------------G------------------GG----------------   2754
94CY032.3    ------------------------------G----------T-------   2768
96ZM651.8    -C-----------CG--------------GG---C-T-----------   2731
96ZM751.3    -C-----------CG--------------GG---C-G-----------   2741
94CY017.41   ------------G----------------G---C-G------------A-   2759
94IN476.104  -C-----------C----------------G-GG---C-T---------   2723

93BR020.1    GAGCCAAGGCACTAACAGACATAGTGCCACTGACTACAGAAGCAGAGTTAGAATTGGCAG    2790
92NG083.2    -G-----A---------------A--C--A--GG---------AA-G--GC-----   2831
90CF056.1    -G-----A---T----------A-A--------A-A---G-----A--G---------   2809
92RW009.6    --A----A---T----------A-----A---GA-------A-----------   2794
92NG003.1    -G-----A--------------A--------GA-------A-----------   2829
93BR029.4    --A----A-----------AG---A------A--AG----G-----C-----C------   2814
94CY032.3    ----T--A--C----------A-----A--------G---------------A----   2828
96ZM651.8    ------A--------------A------A---GA--------A-----------   2791
96ZM751.3    ------A--------------A--T-----GA--G-----A-----------   2801
94CY017.41   ------A--------------AA---------A-----------------A-A--   2819
94IN476.104  -G-----A---------------A-----A---GA---------A--------A----   2783
```

Fig. 13H

```
93BR020.1    AGAATAGGGAGATTCTAAAAGAACCAGTACATGGGGCATATTATGACCCGTCAAAAGACT    2850
92NG083.2    ----C-----A--------------T--------A-TC---C--------A--------A-   2891
90CF056.1    -A--C--------G-G------A-------A-A---------T--A------------       2869
92RW009.6    -A--C-----A---T---------------A-T----------A---------            2854
92NG003.1    ----C-----A--------------T--------A-TC--C--------A--------A-    2889
93BR029.4    -A--C---------------------A-TG--- --------A-------              2874
94CY032.3    ----C-                                  ----A--------            2888
96ZM651.8    ----C-A---A---T----------T-------------A--------     ----       2851
96ZM751.3    ---GC-----A--------------A-T----------A-----------              2861
94CY017.41   ----C-----A---T-----ACC--T----------T---C--------A--------     2879
94IN476.104  ----C-----A-----------G---------A-T----------A-----------       2843

93BR020.1    TAATAGCAGAAATACAGAAACAAGGGCAAGGGCAATGGACATATCAAATTTATCAAGACC    2910
92NG083.2    ----------G-------G-------C--AC-------------------G----        2951
90CF056.1    ------------G---G----------C----------------------G----        2929
92RW009.6    ------T-------------G-----T-AC---------------------C-----A-    2914
92NG003.1    ------T---------------TGC-AC------------------------           2949
93BR029.4    ---------------------G-------C----------------------           2934
94CY032.3    ---------------G----         ---T--------------------A--------  2948
96ZM651.8    -G----T-----------------T-AC---------------------C--G--A-      2911
96ZM751.3    ------T-----------------T-AC------------------G----C-----A-    2921
94CY017.41   -------------------AC---------------------------G--A-          2939
94IN476.104  ------T-------G---  T-AC---------------------C-----A-          2903

93BR020.1    CATTTAAAAATCTAAAAACAGGAAAGTATGCAAAAATGAGGTCTGCCCACACTAATGATG    2970
92NG083.2    ---AC-------------------A----------G-G--------------------     3011
90CF056.1    --------G--G---------A---------AA-------------------A          2989
92RW009.6    ----C------G-------------------G----A-----------------C-       2974
92NG003.1    ---AC----G---------------------G-G---------------              3009
93BR029.4    ---A-------T-G---------------GG-----GG----                     2994
94CY032.3    --CA-------G------  G ---------G--CC--A------                  3008
96ZM651.8    ----C------G-------G-----------------A-A---------              2971
96ZM751.3    ----C-----G-------------------A---------'---                   2981
94CY017.41   -C-----G-----G---------G--A-----------G------CA----------A     2999
94IN476.104  ----C-------G-------G-----------------A---T----- -----         2963

93BR020.1    TAAAACAGTTAACAGAAGCAGTGCAAAAGATATCTCTAGAAAAGCATAGTAATATGGGCA    3030
92NG083.2    ------A------------T---------A---G-CAC---GG----------C-----A-  3071
90CF056.1    -------A--------------------AC------------------------A-       3049
92RW009.6    ------------G-----------------G-CA-G-----------------A-        3034
92NG003.1    ---------------------A---G-CAC---G-----------------A-          3069
93BR029.4    -------AC------G----------A---A-CAC------------------A-        3054
94CY032.3    -T-G---A------------------G-CA-G---T--------  ------A-         3068
96ZM651.8    ---------------G---------A---G-C--G--G-------------A-          3031
96ZM751.3    ---------------G--G---------A---G-CA-G-------------A-          3041
94CY017.41   ---------------------A------A--A-CA-G----------G----- ---A-    3059
94IN476.104  ------------------G------  ---A---G-CA--------------.A-        3022

93BR020.1    AGACTCCTAAGTTTAGACTACCCATATTAAAAGAGACATGGGATACATGGTGGACAGAGT    3090
92NG083.2    ---T------A----A-------T---CG------A--------AGT-------------   3131
90CF056.1    -A-T------A----------T---CA------A---------G--C-------------   3109
92RW009.6    ------------A-------T-------CCAG------A--------A-----------C-  3094
92NG003.1    -AGT------A----A-------T---AGG------A--------AGT-----------A-  3129
93BR029.4    ---T------A----A---------CA------A--G-----AG---------T-----    3114
94CY032.3    -----------------------T----CA---G--A---------C------------A-  3128
96ZM651.8    ---T------A---------CCA------A---------A-----------C-          3091
96ZM751.3    ---T------A-----G--------TCA------A--------G--------------C-   3101
94CY017.41   ----------A----A-T--------CA---G--A---------G---------G-G----  3119
94IN476.104  ----C-----A-----------------CCA------A--G-----G--------------C- 3082

93BR020.1    ACTGGCAAGCCACCTGGATTCCTGAGTGGGAGTTTGTCAATACCCCCCCTCTAGTAAAAC    3150
92NG083.2    -------G---G--------------------A-----------T--------------T    3191
90CF056.1    -T--------------A-----------------T--C-----T-A---------T       3169
92RW009.6    -T-------------------------------T--------T--C---------T       3154
92NG003.1    -T-----G-----------T-------------T---------------GT            3189
93BR029.4    -T------------------------------------T--CT----G---T           3174
94CY032.3    -T-----G--------C-----A-----A-----------T-----------T          3188
96ZM651.8    -T-------------------------------T--------T-TCT--------T       3151
96ZM751.3    -T------------------------------T-----T-------C--------T       3161
94CY017.41   -T-----G--T------------------------T--------------T            3179
94IN476.104  -T-----G-----------T-----------T--------T--C---------T         3142
```

Fig. 13I

```
93BR020.1    TATGGTATCAGTTAGAAACAGAGCCCATAGTAGGAGCAGAAACCTTCTATGTAGATGGGG    3210
92NG083.2    ----------A----------A------CC----------T-A----------------    3251
90CF056.1    -------------------------------C---------T-A----A-----------   3229
92RW009.6    -------C---C----G-A---A------T----------G-T-------------A-    3214
92NG003.1    --------GA----------A------CC----------T-A-----------------    3249
93BR029.4    -------C-------G-A---A---------------T---------------------    3234
94CY032.3    -------C----------------C-----C---------T------------------    3248
96ZM651.8    -------C---C-G--G-A---A---------------------------------A-    3211
96ZM751.3    -------C---C-G--G-A---A-------C--------T-A--------------A-    3221
94CY017.41   -G-----C---------A---A------C---------T--------------------   3239
94IN476.104  -------C---C------A---A---------------T-----------------A-    3202

93BR020.1    CATCTAATAGAGAGACCAAAAAAGGAAAAGCAGGATATGTTACTGACAGAGGAAGACAAA    3270
92NG083.2    --G-------G-----A---TT------G-----C--------------A-----A----  3311
90CF056.1    --G---------G--A--T---TT----------------C-----T------AG----   3289
92RW009.6    --G------C-G--A--T----T---------G----------------------G--G-  3274
92NG003.1    --G------A---A--A---TT------G----------------------A-------   3309
93BR029.4    --G-------G--A--T---TT------------------G------------------   3294
94CY032.3    --G----------A--A---C-G---------------------T-----C--------  3308
96ZM651.8    --G-C-----G--A--T---T----------C---A-----------------G----    3271
96ZM751.3    --G-C-----G--A--T----T----------G-----------------------G----  3281
94CY017.41   --G----------T---CT------G-----G-----C-------------------   3299
94IN476.104  --G------G--A--T---GT----------G----------------------G---G-  3262

93BR020.1    AAGCGGTCTCCCTAACTGAGACTACAAATCAGAAGGCTGAGTTACAAGCAATTCAGTTAG    3330
92NG083.2    --ATTA-TA----------A--A-----C--A---------A-----T--------AC---  3371
90CF056.1    ---TT----------G--A--A-------------A----A------------T-TC---  3349
92RW009.6    --ATT--T--T--------A--A-------------A----A-----------------C---  3334
92NG003.1    --ATTA--A--A--CAG--A--A---------A--AA----A-----C---------C---  3369
93BR029.4    ---TT---C------G--C--A-----------AA-----------------------TC---  3354
94CY032.3    ---TT----------T----A--A------------A----A------------T-C----  3368
96ZM651.8    --ATT--TA-T--------A--A-------------A----A-----------T-CC,---  3331
96ZM751.3    --ATT--TA-T--------A--A-------------A---A----A---------------  3341
94CY017.41   --ATT--------G--G--------A-------------A----A-----T-----CT-T--G-  3359
94IN476.104  --ATT--T--TT-------A--A-------------A----A--G-------------C---  3322

93BR020.1    CTTTACAGGATTCAGGATCAGAAGTAAACATAGTAACAGACTCACAGTATGCATTAGGAA    3390
92NG083.2    ----G-----C---A--C-----------------------------------------   3431
90CF056.1    ----G--A--------G-T-----G--------G-----T-----------C------    3409
92RW009.6    ----------------------------------------------------------    3394
92NG003.1    ----G-----------------------------------------------------   3429
93BR029.4    ----G--------G----T--------------------A--------------A----    3414
94CY032.3    ----G----------------------------------------------A------    3428
96ZM651.8    ----G--A---------------------------T------------G-------    3391
96ZM751.3    ----G-----------------------------------------------------    3401
94CY017.41   --------------T------G--------G------T---------------------   3419
94IN476.104  ----G--A--------A-----------------------------------------   3382

93BR020.1    TCATTCAAGCACAACCAGATAAGAGTGAATCAGAGTTAGTCAATCAAATAATAGAGCAAT    3450
92NG083.2    --------------------G-----G------A------------------A--GC    3491
90CF056.1    ------------------C----------------T-------------------G---    3469
92RW009.6    ----------------GC--C-----G---GC-------------------A--G-    3454
92NG003.1    ------------------G--------A--------------------A--GC    3489
93BR029.4    ----------------T--AA---------------------------------G-    3474
94CY032.3    ---------------GA-------T-----T-------------------A----    3488
96ZM651.8    ---------------T----------------------C-----------A----    3451
96ZM751.3    ----C---------------------A---------------------A--G-    3461
94CY017.41   -------------A-G---------A---------------------AA---    3479
94IN476.104  ------------------A----------------C----------A----    3442

93BR020.1    TAATAAAAAGGAAAAGGTCTACCTGTCATGGGTACCAGCACACAAAGGGATTGGAGGAA    3510
92NG083.2    -------------------------------------------------------    3551
90CF056.1    ------G-----------------------------------A-------------    3529
92RW009.6    -------------GA---------T-----AA----------A--------G----    3514
92NG003.1    -----------------T-AA---------------------A----G---    3549
93BR029.4    ---------A---G--------------------A---------------   3534
94CY032.3    -----CGG-----C------------------------------------   3548
96ZM651.8    -------G------G---------------------T-----A--------T-    3511
96ZM751.3    -G-----G------G---T---------------------A-----------   3521
94CY017.41   -------G---------G--------A-----------------------   3539
94IN476.104  -------C--A---GA-----T---------------T-----A--------G-    3502
```

Fig. 13J

```
93BR020.1   ATGAACAAGTAGATAAATTAGTCAGTGCTGGAATCAGGAAAGTACTGTTTCTAGATGGGA  3570
92NG083.2   ------------------GC--------AG----------------T-A--T-G-----C-  3611
90CF056.1   ---------------------T--T-----G----A-----G--A-------------  3589
92RW009.6   --------------------A---AG----------G---G---------------A-  3574
92NG003.1   --------------------AG--------A-----------T------C-  3609
93BR029.4   ---------------C-------------T---------------A--T-------A-  3594
94CY032.3   ---------------------CAA---------A--G--G--A---T-------A-  3608
96ZM651.8   -------G-------------A--CAAG--------------G--------------A-  3571
96ZM751.3   --------------------G--A---AG---------------G--------------A-  3581
94CY017.41  ---------------C-------T----------------G--A---T---------  3599
94IN476.104 ---------G------A---AG------T-------------------------  3562

93BR020.1   TAGATAAGGCACAAGAGGAACATGAAAAATATCACAACAATTGGAGAGCAATGGCTAGTG  3630
92NG083.2   --------A--C-----A----------G--------G-----------------------  3671
90CF056.1   --------A--T-- -A---------GG------T----------G-----------  3649
92RW009.6   ----------T-----A----------G---------G-----------------------  3634
92NG003.1   ----C--A--T-------C------G--------G--------------------------  3669
93BR029.4   ---------C-----A--------G--------T--------------------------  3654
94CY032.3   ----------T ----A--------G---------T--C----------------------  3668
96ZM651.8   ----C------T-----A--G--------------------------------------  3631
96ZM751.3   ----------T-----A--G--------G-------------------------------  3641
94CY017.41  ----------T-------------G--------G--------------------CA--  3659
94IN476.104 ----------T-----A--T--------G--------G-------------------A--  3622

93BR020.1   ATTTTAATATACCAGCTGTAGTAGCAAAAGAAATAGTAGCTAGCTGTGATAAATGTCAGC  3690
92NG083.2   --------C-G---C--------------------G--C-----------------A-  3731
90CF056.1   --------C-----C--A--------------------------------------  3709
92RW009.6   --------C-G---C--A---------G-------------C-----------G-------  3694
92NG003.1   --------C-G---C--A---------G--C-----------------------------  3729
93BR029.4   -C------C-----C----------------------C---------------------  3714
94CY032.3   --------C-G--T-A--G----------G-------------A-------------  3728
96ZM651.8   -A------C-----C-A--------------------T-------------------  3691
96ZM751.3   -G------C-G---C-CA----------------C-----------------!---  3701
94CY017.41  -C------C-----C----------------------------------------  3719
94IN476.104 -G------C-G---C CA-----------------------------------C----  3682

93BR020.1   TAAAAGGGGAAGCCATGCATGGACAAGTAGATTGTAGCCCAGGGATATGGCAATTAGATT  3750
92NG083.2   ----------------------------C-----T-----A----------------  3791
90CF056.1   ----------------------------C---------A-----------------  3769
92RW009.6   ---------------G--------C----T-----------------------C-  3754
92NG003.1   ----------------------------C-----T-----A----------------  3789
93BR029.4   -------A--------------------C-----T-----A------GC------  3774
94CY032.3   -------------------G--C-----T-------------G-------  3788
96ZM651.8   A-------------CA------------C-----T----------------C-  3751
96ZM751.3   -----------------A----------C-----T-----A----------------  3761
94CY017.41  ------------------------C-----T----A---------C------  3779
94IN476.104 --------------- --------CC----------------------  3742

93BR020.1   GCACACATTTAGAAGGAAAAATTATCCTGGTAGCAGTCCATGTAGCTAGTGGGTACCTAG  3810
92NG083.2   -T----------------A-A--------T--------C-----C--TA---  3851
90CF056.1   ---------G------C-G----T-------------------C-----C--TA---  3829
92RW009.6   -T------C-G----------A------------------C---C-----T--TA---  3814
92NG003.1   --------C----------G-C--TA-A----------------C-----C--TA---  3849
93BR029.4   -T----C--------------G-------------------CG----A--TA---  3834
94CY032.3   -T---------T---G-----A--------T-----G---------A---A---  3848
96ZM651.8   -T----------C----------------------C-----C---A--  3811
96ZM751.3   -T--C-----------G-C---T-------------------C-----T---A---  3821
94CY017.41  --------C-T---------G-------------G--C-----CA---  3839
94IN476.104 -T------C----------C---------------------C-----C---A---  3802

93BR020.1   AAGCAGAAGTTATCCCAGCAGAAACAGGACAAGAGACAGCCTACTTCCTACTAAAGTTAG  3870
92NG083.2   -----------------------G--G--A-----A--------TA--T----A----  3911
90CF056.1   ---------C------------A-G--A-----A--------GT-G--AC---  3889
92RW009.6   -------G-----T--------------A-----A-------TA-------A----  3874
92NG003.1   -------------------------G--------A--------G-----A----  3909
93BR029.4   ---------------T--------G-----G-----A------T--CT------  3894
94CY032.3   ------------------------G--A-----------A------A----  3908
96ZM651.8   -------G-------------------A-----A----ATA--T----A----  3871
96ZM751.3   -------G--C-C-----G-----------A-----ACTT--A-------A----  3881
94CY017.41  --------C------A-------------G--T-----A-----TA--T----AC---  3899
94IN476.104 -------G-------------------A-----A----ATA-------A----  3862
```

Fig. 13K

```
93BR020.1    CAGGAAGATGGCCAGTAAAAACAATACATACAGACAATGGCACCAATTTTCACCAGTGCCA    3930
92NG083.2    -------G------------GTG----------------TC---------T-----TG    3971
90CF056.1    --A-C-----------GT-------------------G---------G-----TG        3949
92RW009.6    -------------C---GT------------------GT-------------AAT-        3934
92NG003.1    ----------------GT-----C---------------G-----------------TG    3969
93BR029.4    ----------------------C------------------G----------A-T-       3954
94CY032.3    ----------------G----TG------G------C---C----------------TG    3968
96ZM651.8    ----------------C---GT---------------T-G-----T---------TG      3931
96ZM751.3    -----------C---GT-G-----------------GT---------------TG         3941
94CY017.41   ----------------GT-------------------GC-------T------A-        3959
94IN476.104  -------------C---GT------------------T-GT--------------TG      3922

93BR020.1    CGGTTAAGGCAGCTTGTTGGTGGGCAGGTATCCAGCAGGAATTTGCAATTCCTTACAACC    3990
92NG083.2    -A--A--------A-----------AA----ACA-------------C-----T-         4031
90CF056.1    -------------C------------A------A-----------G-----C----T-      4009
92RW009.6    -A--A-----C----C------------------A--------------C-----T-       3994
92NG003.1    -AA-G--A----C------------AA------A---------------C-----T-       4029
93BR029.4    -A--C-----C--C-----------G--G---A---------------C-----C-----T-  4014
94CY032.3    -------------C-----------A----A-C----------------C-----T-       4028
96ZM651.8    -A-----------C-----------A-A--A---------------------C-----T-    3991
96ZM751.3    -A--C--------C-------------C---------------------C-----T-       4001
94CY017.41   -A-----------C-----------A--A-------G----C----T-                4019
94IN476.104  -A-----------C------------A------------------C-----T-           3982

93BR020.1    CCCAAAGTCAAGGAGTAGTAGAATCTATGAATAAAGAGCTAAAGAAAATCATAGGACAGA    4050
92NG083.2    -------C-----------G----------G--AT-------------C-----G         4091
90CF056.1    ---------G-----------------------AT-------G-----   G---G        4069
92RW009.6    ---------G------A-----C----------AT----------T-----G---G        4054
92NG003.1    -------C   ----G-----------------AT-------------T-----G---G     4089
93BR029.4    -----------A---------------------AT-------------T----------G    4074
94CY032.3    -------C-----------G-------------AT-----------------G---G       4088
96ZM651.8    -A--------G-----------C----------AT-----------------G---G       4051
96ZM751.3    -----------------------C---------AT------------T-----G--'G      4061
94CY017.41   ---------G-----------------------AT-----------------G---G       4079
94IN476.104  -------C--G-----------C----------AT------------T-----G---G      4042

93BR020.1    TAAGAGATCAAGCTGAACATCTTAAGACAGCAGTCCAAATGGCAGTATTCATTCACAATT    4110
92NG083.2    -TG---------------------------A--G-------------------           4151
90CF056.1    -------C-----A-----C------------A-------------------            4129
92RW009.6    -----------------G--C--G--------A-------------------            4114
92NG003.1    -C--G-----------C--C--------A--G-------------------             4149
93BR029.4    ----G-----G-----------------A----C-------------C-------         4134
94CY032.3    -C--G-----------C-----------A--G-------------------             4148
96ZM651.8    ---------G-----G----------A----A-------------------             4111
96ZM751.3    ---------G--C---------------A-------------------                4121
94CY017.41   -------C--------------------A-------------------                4139
94IN476.104  -------A------G--C----------A-------------------                4102

93BR020.1    TTAAAAGAAAAGGGGGGATTGGGGGATACAGTGCAGGGAAAGAACAATAGACATAATAG    4170
92NG083.2    ------------------G-----------------T-------------              4211
90CF056.1    ------------------G-----------------T-------------              4189
92RW009.6    ------------------G-----------------T-------------              4174
92NG003.1    ------------------G-----------------T-------------              4209
93BR029.4    ------------------G-----------------T-G-----------              4194
94CY032.3    ------------------G-----------------T-------------              4208
96ZM651.8    ----------A-------G-----------------T-------------              4171
96ZM751.3    ------------------G-----------------T-------------              4181
94CY017.41   ------------------------------------T-------------              4199
94IN476.104  ------------------G-------------------------------              4162

93BR020.1    CAACAGACATACAAACTAGAGAATTACAAAAACAAATTATAAAAATTCAAAATTTCCGGG    4230
92NG083.2    --T----T---------A----C---------------------T----               4271
90CF056.1    ------------A--------------TC---C---------A--T----              4249
92RW009.6    ------------AG---------------C--------------T----               4234
92NG003.1    --T----T---------A----C--------G------------T----               4269
93BR029.4    ------------G----A---------------C----------T---                4254
94CY032.3    --T----T---------A----C----------C----------T----               4268
96ZM651.8    ------------C-A---C----------------C-------A--T--               4231
96ZM751.3    -------------------------------------------T----                4241
94CY017.41   ------T---------A----C-----G-----C----------T----               4259
94IN476.104  -------------A-------C--------C-------------T----               4222
```

Fig. 13L

```
93BR020.1    TTTATTACAGGGACAGCAGAGACCCAGTTTGGAAAGGACCAGCAAAGCTACTCTGGAAAG    4290
92NG083.2    ------------------------------A---------------------A--C---------    4331
90CF056.1    ---------------------------A------------------------A--C---------    4309
92RW009.6    -------------------T---A--------------------C--A---------------    4294
92NG003.1    -C--------------------------CA-----------------------A----------    4329
93BR029.4    ------------A-----------T---C-----------------------T-----------    4314
94CY032.3    -----------------------A---A------G----------------A------------    4328
96ZM651.8    ----------A-----------------CA---------------------C--A---------    4291
96ZM751.3    ----------A---------------TA-----------------------C--A---------    4301
94CY017.41   -------------------T---A----------------------------A--C--T------    4319
94IN476.104  ----------A-----------------CA---------------------C--A--G------    4282

93BR020.1    GTGAAGGGGCAGTAGTCATACAAGACAATAGTGAAATAAAGGTAGTTCCAAGAAGAAAAG    4350
92NG083.2    -----------------A-----G-------AC---------------A-----------    4391
90CF056.1    -----------------A--------------------A-----A----------G-G--    4369
92RW009.6    -----------------A-----G------------T-----A-----A-----------    4354
92NG003.1    -----------------A-----G------------G-----------A-----------    4389
93BR029.4    -----------------A------T-------------C-----A-----G---------    4374
94CY032.3    -----------------A-----G-----C----T--C--A-----A-------------    4388
96ZM651.8    -----------------A------T---------C-----A--G--A-----G--G----    4351
96ZM751.3    -----------------A------T---------C--------A-A------G--G----    4361
94CY017.41   -----------------A--------------C------------A--------------    4379
94IN476.104  -----------------A------T---------C-----------G-----G--G----    4342
                                      → VIF start
93BR020.1    CAAAGATCATTAGGGATTATGGAAAAACAGATGGCAGGTGATGATTGTGTGGCAGGTAGAC    4410
92NG083.2    --------C---A----|-----------------G------------------------    4451
90CF056.1    ----A------------|----------------------------------A-------    4429
92RW009.6    -----------------|-------------------------------------------    4414
92NG003.1    T---A-------A----|-----------------G-------------------------    4449
93BR029.4    T----------------|-----------------G-------------------------    4434
94CY032.3    ------T-----C----|--C---------A------------------------------    4448
96ZM651.8    ----A-----------C|----------------C-C------------------------    4411
96ZM751.3    ----A-----------C|---------------AC----A---------------------    4421
94CY017.41   -----------------|-------------------------------------------    4439
94IN476.104  ----A--T---------|-----------------C-------------------------    4402
             POL end ←        |
93BR020.1    AGGATGAGGATTAACACATGGAAAAGTTTAGTAAAATACCATATGCATATTTCAAAGAAA    4470
92NG083.2    --------------GA--------C-T-----T--G-C---------G----         4511
90CF056.1    --------------GA------C-------G-------------------------    4489
92RW009.6    --------A-----GA--------T---C------GC---------T--CC-----G--G-    4474
92NG003.1    --------------GA--------C-------------T------T---AA--T-----    4509
93BR029.4    --------------GA-----------------------G-------------------    4494
94CY032.3    --------A-----GA--------C---C----G---C-T------T--G---------    4508
96ZM651.8    --------------GA--------T----------GC---------T---------CG--    4471
96ZM751.3    --------A-----GA--------T----------GC---------T--G------A-G-    4481
94CY017.41   --------------GA------C----------T--C-T-------T--------G---    4499
94IN476.104  ----------C-GA--------T-|---------C---------T--G------GA-G-    4462
                              POL end ←
93BR020.1    GCCAAAGGATGGTTTTATAGACATCACTTTGAAAGCAGGCATCCAAAAATAAGTTCAGAA    4530
92NG083.2    --T-----C-----------------A----------------G-G--------------    4571
90CF056.1    --T-G-----------------------T---------CT-------GG-----------    4549
92RW009.6    --T-G-----------------T-A--------A----------------G---------    4534
92NG003.1    --T--G-AT----------------------A-----T------------G-G-------    4569
93BR029.4    ------A-------------------------------------------G---------    4554
94CY032.3    --T--------A--C----------A------T-----C-------G-------------    4568
96ZM651.8    --T--T---------------C----------T-A------------GGG----------    4531
96ZM751.3    A-TGGTA----------C--------T-A--------A----------------------    4541
94CY017.41   --T-----T---G-C----A---------A---------AA------G------------    4559
94IN476.104  --T-GT----------C--------T-A---------A---------G-----G------    4522

93BR020.1    GTACACATCCCACTAGAGACAGCTGAATTAGTAATAACAACATACTGGGGGCTGCTTCCA    4590
92NG083.2    --------------AGAGAT---AC-C-----G---G------T-----T----A-G--    4631
90CF056.1    ---------T---GAGA----AGG-----C-----C---------T---AA-A--     4609
92RW009.6    ---------T---G-GA----AG------G-----A-------T-----TT---AAA--    4594
92NG003.1    ---------G-GAG---AG-------G---G------T-----T----A-A--    4629
93BR029.4    -----T--------GA----A---------------T----------A-A--    4614
94CY032.3    -----T-------G-GAG---AG------G---G------T--------T----AG---    4628
96ZM651.8    -----T-------T--G-GAT---A--------A------T-----TT---AAA--    4591
96ZM751.3    -------------T--G-GAT--CA-----------A-----T----------A----    4601
94CY017.41   ---------G----G-GAG---AG-A--A--G---G------T-----T----ACAT-    4619
94IN476.104  ------------T---GAGAT---AG---------A------T-----TT-A-AAA--    4582
```

Fig. 13M

```
93BR020.1   GGAGAAAGAGAATGGCATCTGGGTCAGGGAGTCTCCATAGAATGGAGGCAGGGGAGGTAT   4650
92NG083.2   --------A---C-----AT----C--T--G--T----------------AAA--A---   4691
90CF056.1   ---------- ---------T-A--C------------------------A-T-AAA------   4669
92RW009.6   --G-------T------T-------T------------------ATT-A-A--A---   4654
92NG003.1   ----------C-  --CT----------G----------------A----A-A--A---   4689
93BR029.4   -----------T------------------------  -----------------------   4674
94CY032.3   --G---CA---C-----CT-------T----------------TCA-A--A---   4688
96ZM651.8   ----------T------T-------T------------------ATT-A-A--A---   4651
96ZM751.3   --G-------T------T-------T------------------ATT-A-A--A--C   4661
94CY017.41  ----------A---C-----CT-------T--------------------AAAC------   4679
94IN476.104 ----------T------T-------T--C---------------ATT---A--A---   4642

93BR020.1   AGAACACAAATAGACCCTGGCCTGGCAGACCAACTGATCCATATATATTATTTTGATTGT   4710
92NG083.2   --T------------AA-ACA--------T-----T---C-G----------C---   4751
90CF056.1   --C------G---G-----------------A--T-----GC--------------   4729
92RW009.6   -AG------G------------------G------A---------GC--------------   4714
92NG003.1   --C-----------T----A--A--------------T--CC-GC--------A-C---   4749
93BR029.4   --G---------------------------------------------------------   4734
94CY032.3   --C------G-G--T----A-----------A--T-----GC----C---------   4748
96ZM651.8   --C------G--------------------G--A--T-----GC-C------------   4711
96ZM751.3   --C------G----------------------G--A--T-----GC--------A------   4721
94CY017.41  CAT-------------AT----------T--A------C-G---------C---   4739
94IN476.104 --C------G-----A-----------------G--A--------GC-------------   4702

93BR020.1   TTTTCAGAATCTGCCATAAGGAAAGCCATATTAGGACATAAAATTAGCCCTAGGTGTAAC   4770
92NG083.2   ----------------------A-----------G-G-T-G-----------G-A   4811
90CF056.1   -------------- ----------------------G-GT-G----A-------------   4789
92RW009.6   ---G----C-----------------------------T-G-----------G--   4774
92NG003.1   ----------G---G----------- ---C-----G-AGT-G---A---------G-A   4809
93BR029.4   -------------------------------------G---------------G-T   4794
94CY032.3   ------------------------------------G-G----T---------G-A   4808
96ZM651.8   ---G----C---------A-----------C-T-G---TT---------G--   4771
96ZM751.3   ---G----C---------A-----C--C------T-G---TT--------G-T   4781
94CY017.41  ----------------------------A-----G-A-T-G----T--------G-A   4799
94IN476.104 ---G----C-----------A----------------C-T-G---TTT--------G-T   4762

93BR020.1   TATCAAGCAGGACATAACAAGGTAGGATCTCTACAATACTTGGCACTAACAGCATTAATA   4830
92NG083.2   --C-C------------T------------TC-----TCG-A-------G---   4871
90CF056.1   ----C----------AC-------A----------T----------G-G   4849
92RW009.6   ----------------T-----------------A-----T-----C-A-------G---   4834
92NG003.1   ------A--------TC-------  --A-----T--A-----C-A-------G---   4869
93BR029.4   --------------------------------------G---------------------   4854
94CY032.3   --------------T----------CT--------C--------G----------   4868
96ZM651.8   --------------T------------G---------------G-------G---   4831
96ZM751.3   --------------T------------C-----------------G-------G---   4841
94CY017.41  ---------------G-----G-----T------T-G-A----G--G--   4859
94IN476.104 --------------T-------------------------------G-------G-*-   4822
                                                                 →VPR start
93BR020.1   GCTCCAAAAAAGACAAAGCCGCCTTTGCCTAGTGTCCAGAAACTAGTAGAAGACAG|ATGG   4890
92NG083.2   A-A----C--G--A--G---A--------A------TGG----T---C-------T-|---   4931
90CF056.1   --A----------T------A--------------TAGA--G--------G--T-|---   4909
92RW009.6   AAA----------T------A---C----------TAGT---T--------G--T-A|---   4894
92NG003.1   A-A----C-C----------A-----A--------TA----GT--AC-------T-|---   4929
93BR029.4   AAA----------G------A---------C----TA--------GAC---G--T-|---   4914
94CY032.3   T-C------------------A--------TA----------G--G--T-|---   4928
96ZM651.8   AAA----------G------A---C----------TAG----T--------G--T-|---   4891
96ZM751.3   AAA----------T------A----A---------TAG----T--------G--T-|---   4901
94CY017.41  ---T---C--G-----A----------TAG----T--------G--T-|---   4919
94IN476.104 AAA----------G------A---C---------TA-----T--------G--T-|---   4882
                                                              VIF end ←|
93BR020.1   AACAAGCCCCAGAAGACCAGGGGCCACAGAGAGAGCCATACAATGAATGGCACACTAG|ATC   4950
92NG083.2   ------------------------A----------A--C-----------T---|-A-   4991
90CF056.1   ------------------------G------C-----------------|-G-   4969
92RW009.6   ------------------------G-----G-A---------------------|-G-   4954
92NG003.1   ---G-------------------G------T---C-----------------|-A-   4989
93BR029.4   --------------A--A------G----------------------------|-A-   4974
94CY032.3   ------------------------G--------A---A-T----------------|-G-   4988
96ZM651.8   ----TT---------------A----G-----G--A--------G---C----------|-GA   4951
96ZM751.3   --------------A----A------G-----G--A---------T----------G-----|-G-   4961
94CY017.41  --------------A-----------A------G--------------TGT---|-A-   4979
94IN476.104 -----T---------------A------G--A-----------------|-G-   4942
```

Fig. 13N

```
93BR020.1    TTTTAGAGGAGCTTAAGAATGAAGCTGTTAGACATTTTCCTAGGCCATGGCTCCATAGCT   5010
92NG083.2    -G-----A--------A--------------------------C---------G---      5051
90CF056.1    ----------A---------G-----------G------------AGT----------CAA-  5029
92RW009.6    ---------CA--C---C-G---------C------C---------A----------GA--  5014
92NG003.1    -G-----A--A-----AC---------------...........-----T---G-A--    5036
93BR029.4    ----------A-------G--------------------TT-----------------      5034
94CY032.3    ----G---------A--------------G---------A--C----------G--C     5048
96ZM651.8    --C--------A--C---C-G--------C------C--------A-----------      5011
96ZM751.3    ---  ----  ----C---C-G--------C---:--C---------AA------------A--  5021
94CY017.41   -G---------C---C-G------------C-------AC-----A---G--C         5039
94IN476.104  --C--------A--C--C-G---------C------C----------A--T-A---T------  5002

93BR020.1    TAGGACAACATATCTATAACACCTATGGGGATACTTGGGAAGGAGTTCAAGCAATCATAA   5070
92NG083.2    --------GT-------------T-----------------------C--A----       5111
90CF056.1    --------G------------A----------T-----------TT-A----           5089
92RW009.6    --------T--------G-A-------------AGG-----A------T--A----      5074
92NG003.1    -------------T-----..........----------------T---T--A---      5096
93BR029.4    ---------------G-A--T--------------C------G-----C--A----      5094
94CY032.3    --------G--------T-----A----C---------G-------T--A----        5108
96ZM651.8    ---------------G-A--T------------ACT-----C--G---T--A----      5071
96ZM751.3    -----------CC-A-----C-----------ACG--G--------TC-A----        5081
94CY017.41   --------T-C---------T------------C-------------TT-------      5099
94IN476.104  --------T-----G-A--A--------G-----AC-------C-----TT A----     5062

93BR020.1    GGATATTGCAACAACTACTGTTTATCCATTTCAGAATTGGGTGCCGTCATAGCAGAATAG   5130
92NG083.2    -A---C-A------------------------C-------AA------------        5171
90CF056.1    -A-CGC----------------T-----------AA------------              5149
92RW009.6    -A--TC-                     ---------G------------             5134
92NG003.1    -A------------T-----T---------------T-AA------------          5156
93BR029.4    -A--TC---------G--------T-----------A--T-AA------------      5154
94CY032.3    -A--T-----------T-----------------AA-------T------            5168
96ZM651.8    -A---C------------------T---------------AG--C--------, --   5131
96ZM751.3    -A---C--------------T   -------------A----AA------------      5141
94CY017.41   -ATATC------------------G-------------------AA---------G----   5159
94IN476.104  -A-C-C--------T----------T---------------AG--------         5122

→TAT 1st exon start   VPR end◄
93BR020.1    GCAT...TACTCGACAGAGAAGAG.TAAGAA|ATGGAACTAGTAGATCCTAA|CTTAGATCC   5186
92NG083.2    ----..-----C-----------.----GG-|----C-CG-----C-----|GC----G--    5227
90CF056.1    -A--...-----------------.------|----C-C-----------|AC----G--     5205
92RW009.6    ----...-TTG-A-----------.C-----|----G-C-----------|AC----G--     5190
92NG003.1    ----...T--C-GG--------.GC--G-|-----G-G----------|G-C----G--      5212
93BR029.4    ----...--A----------G----.C---G-|----G-C-----------|GAC----G--    5210
94CY032.3    ----TAC-C---A-AG--------GC-G-GG|----G-C----------G-|-C----G--     5228
96ZM651.8    ----...GGT------------.CG---|-----G-C-----------|G-A----G--       5187
96ZM751.3    ----...TG-----------.C------|----G-C------------|AC----G--        5197
94CY017.41   ----... .T----AGA------. ----GG|----G-C------C-----|AC----G--     5215
94IN476.104  ----...TTA-A--G---------.C-----|----G-C-----------|C----G--       5178

93BR020.1    CTGGAACCATCCAGGAAGCCAGCCTACAACTCCTTGTACCAGATGTTATTGTAAATGGTG   5246
92NG083.2    ------T-----G--G--T------------C----A--A--------------GT---    5287
90CF056.1    ------------T------CA----G------A--AT-----------AA---         5265
92RW009.6    -------------------A----G-C----AT-AC-----------CAC--          5250
92NG003.1    --------C-------T--------G------A--A------C------ATA--        5272
93BR029.4    ------G----------T-G----CAG--GG------AT--T--C--------AA---    5270
94CY032.3    ------------G-----T------------GA-----A--AG----TC------AA---  5288
96ZM651.8    ------------T------A----G------AT-AG--------C---C-C--         5247
96ZM751.3    ------T-----T--A----G------AT-AG-----------CAC--              5257
94CY017.41   ------------G----T------A----G------A-----------C-C--         5275
94IN476.104  ------------T-------A----G----AT-C---C---------CAC--          5238
                                                        → REV 1st exon start
93BR020.1    TTGCTTTCATTGTTACTGGTGCTTTACAACGAAGGGCTTAGGCATCTCCT|ATGGCAGGAA   5306
92NG083.2    C----GG------C-AGTT------TT--AC--A---------------|---------    5347
90CF056.1    C----A-------CC-AAT-------TT-A---A---------A--T----|---------  5325
92RW009.6    -A---A-------CTAGTT-----CCAGG--A--A-----------T---|---------   5310
92NG003.1    C----GG-----CC-A-T-----CTG-AC---------------------|---------   5332
93BR029.4    ------------C-AGTT--T--C-----A--------------------|---------   5330
94CY032.3    -----GG-----CC-AGTT-----CTG-AA--A-----------------|---------   5348
96ZM651.8    -A---A-------CTAGTT-----CAG--A--A----------T--A-|---------     5307
96ZM751.3    -A--A-------CTAGTT-----CAG--A--A-----------T----|---------     5317
94CY017.41   -----A-------CC-G-T-------T--AC--A---------------|C--------    5335
94IN476.104  -A---AC------CTAGTT-----CAG--A--A----------T----|---------     5298
```

Fig. 13O

```
93BR020.1   GAAGCGGAGACAGCGACCAAGAACTCCTCAAAGCAGTCAGATACATCAAGATTTTGTACC   5366
92NG083.2   ------------CC----G-G----------GG-----A--GAT------A--CCC------ 5407
90CF056.1   ---------C-------AC---------GC---TTTG--AGAT------A---C-A--T-   5385
92RW009.6   ---------------G--ACG------C-------G-AGAT------A--CC-A--T-   5370
92NG003.1   -------------GC---G-G----------G--TCAC---GAT------A--CC------ 5392
93BR029.4   ---------------AC----------------------C-----------CC-----   5390
94CY032.3   --------A---T----G-G--T---T----G---.CA--GGC------A--C--A----   5408
96ZM651.8   -------------GC--C-------CT-----CG--GAC----------CC-A--T-   5367
96ZM751.3   --------------A----G---CG------C-------G--GAT------A--CC-A--T-   5377
94CY017.41  ------AC---CC----G--AGC--T---C-----A-A--GAC------A--CC-A---   5395
94IN476.104 ---------------GC--CG------C-------G--GAT------A--C--A--T-   5358
            TAT/REV 1ˢᵗ exon end ←              → VPU start
93BR020.1   AAAGCA GTAAGTATTGTTA...AGCATATGTA ATGTCAAATTTG............T   5408
92NG083.2   ------ |------G-AAC-ATT-AT------| ---CAGGCC--A..............G   5452
90CF056.1   ------ |---------A-........C--A.-| ---AT-TA--A..............G   5420
92RW009.6   ------ |----.-G-AA--AAC--T-------| ---A-TTC---A..............G   5415
92NG003.1   ------ |--G----G-AA--GTT--T------G| ---CA-TCC--A..............G   5437
93BR029.4   ------ |-----------AGT-AT--------| -----T-----------.   5435
94CY032.3   ------ |---------AA......T-------| ----T-TTC-G-..............G   5447
96ZM651.8   ------ |-----.........-----------| ----T-G-----ACTAGCAAGAGTAAAT-   5414
96ZM751.3   ------ |-----CAAAG...T-AT-G------| ----T------AGAAGCAAGAGTAGAT-   5434
94CY017.41  ------ |------G-AG--ATT-AT-------| ---T-CC---A..............G   5440
94IN476.104 ----   |---------------------   | ---GTG-----ATTAGAAAGAGTAGAT-   5405

93BR020.1   TAGCAATAGGCATAGCAGCATTAATAGTAGCACTAATAATAACAATAGTTGTGTGGACTA   5468
92NG083.2   A-AT.........ATCTG-C-----------T-C---GC-G-C-C-A---------G--   5502
90CF056.1   G...-T----A----G---GC--G-----A--T-T--C---G-CG--A---------C-   5477
92RW009.6   A-ATCTAT-CA----T----C-G-----G--G-----C---GTG---------------T   5475
92NG003.1   A-AT-GCT-CA------G-C--G--------GCC---GC-G-C-----------....   5493
93BR029.4   ---T------TT----------C-----------G------------------   5495
94CY032.3   A-ATCTGG-CA----T--G-C-GG-------G-----T---GT------A---------T   5507
96ZM651.8   ATAG-G----AG---G-----G------------C-C---G---------------   5474
96ZM751.3   ATAG----AG---G----------------C-----C-G------C---------   5494
94CY017.41  --AT-T-G-CA----T--G-C-G---------TT----CT--G---------A-----   5500
94IN476.104 ATAG-T----AG---G---------------T ---CT--G-----A----------C-   5465

93BR020.1   TAGCATATATAGAATATAAGAAACTGGTAAGGCAAAGAAAAATAAATAGGTTATATAAAA   5528
92NG083.2   ---T--T-----------GA---A-AAG--AA--G-A-------G-A-A----CT-G-T-   5562
90CF056.1   ---T----------------A---T--------AG------G-C---C--AT-G---   5537
92RW009.6   -----GG----------------T-C---A------G-------G--------AT---G-   5535
92NG003.1   .........--CC---GA---A-AAAG-AA--GGAG-----G-C------CT-G-T-   5541
93BR029.4   -----------------G-G----A---------------------   5555
94CY032.3   ---T--T--------------T--AG---------G-G----G-C--C--G--C--T-   5567
96ZM651.8   -------------G---G--T---A-----------G-CT-----AT-----   5534
96ZM751.3   ---T-----------GA---T--TC---A------------G-CC-----AT-----   5554
94CY017.41  ---T--TC----.........-A-TAAG-A-------G------G-CT-----ATC----   5560
94IN476.104 --------C---------G----T--T----A-----------C------AT-G--,-   5525
                                        → ENV start
93BR020.1   GAATAAGCGAAAGAGCAGAAGACAGTGGCA ATGAGAGTGAGGGGGATGCAGAGGAATTGG   5588
92NG083.2   -------A--------------------A- |----------A-------A--------   5622
90CF056.1   -----G-A-------------------- |-C--------T--A--CA-----------AT   5597
92RW009.6   A------A-------------T------ |---------T-----CATT--T-----AT   5595
92NG003.1   -------A-------------T------ |---------A-----CA----------   5601
93BR029.4   -------A-------------------- |--------------------------   5615
94CY032.3   -------A-------------------- |---------T-----------------AT   5627
96ZM651.8   ----T--G-------------------- |---------A---A-T----------   5594
96ZM751.3   ----T--A------G------------- |---------A------AAT-------   5614
94CY017.41  -------T--G----------------- |---------T-----CA--------C-AT   5620
94IN476.104 ----T--G-------T------------ |---------A-T----------T   5585
                                                              VPU end ←
93BR020.1   CAGCACTTGGGGAAGTGGGGGCCTTTTATTCCTGGGGACATTAATAATCTGTAA TGCTGCA   5648
92NG083.2   --A-----AT----A-----GAC---GA----T---TTGG-------T----G ---CT--   5682
90CF056.1   -CAAG---AT---GA------ACC---A--T----T-TG--GC-G------G ------   5657
92RW009.6   --AA-----T--GG------AAC-A-GA--T------TG----C---T----G -------   5655
92NG003.1   --A-----T---CA---T-GAC---GA----T---TTGG------T----G ---CT--   5661
93BR029.4   -----------A---------------T--G------ |----A-   5675
94CY032.3   -CA-----T--G-A-----AAC---GA----T---TTGG-G---------G ---CT--   5687
96ZM651.8   --A-GA-G-T---CA------A-C---GG-T-TT---TG-----G--T----- |-TGTGG   5654
96ZM751.3   --A---A-G-T---TA------A-C---GG-T-TT---TGC--T-G--G----- |-AATG   5674
94CY017.41  ---------T---GAG------A-C--GA-TT------TG---------G----- |A---A--   5680
94IN476.104 --A----G-T---TA-----AA-C---GG-T-TT---TGC----G--T-A--- |--TA-T-   5645
```

Fig. 13P

```
93BR020.1    GAAAACTTATGGGTTACAGTCTATTATGGGGTACCTGTGTGGAAAGAAGCAACCACTACT    5708
92NG083.2    --T-----G-----C----------------------------G----T---GAT--CC-C    5742
90CF056.1    C-------G--------A-------------------------------G----AA--C---   5717
92RW009.6    A-C----G-------T-----C--------------------------C---GAG--C--C    5715
92NG003.1    A-T-----G----C------------------------A------G----C---GAT--CC--  5721
93BR029.4    A-C...--G-----C---------------------------------------------   5732
94CY032.3    A-C----G----C----T-------------------------G---C---GAG--C--C    5747
96ZM651.8    -GG----G-----C---------------------------------------AA------   5714
96ZM751.3    -GG--A--G-----C-----C---------------------------------AA------   5734
94CY017.41   -T...--G-----C-----A--C-----A----------------T---GAT--C-TC     5737
94IN476.104  -GG-----G-----C---------------------------------------AA------   5705

93BR020.1    CTATTCTGTGCATCAGATGCTAAATCATATGAAAAAGAGGCACATAATGTCTGGGCTACA    5768
92NG083.2    -----------C--T--------------AGTTCT--AAA-------------------   5802
90CF056.1    -------------------GG-------G-C---AAAG-------------------   5777
92RW009.6    T----T---------------G-------TCC---AAAG-------------------   5775
92NG003.1    -----T--------T------G-----AGT-CT--AAG-------------C---   5781
93BR029.4    T--------------------G----------A------------------   5792
94CY032.3    -----T---------A------G------G-----A-T-------A---------   5807
96ZM651.8    -----------------------------G-----A-TG-------------   5774
96ZM751.3    T----T--------------G-------G-C--A-TC-------T--------   5794
94CY017.41   -----T--------------T-C--A-TG--------A-----C---   5797
94IN476.104  T--------------G-T-----G--G----TG-----------A-----------   5765

93BR020.1    CATGCTTGTGTACCCACAGATCCCAATCCACAAGAAGTAGTTCTGGAAAATGTAACAGAA    5828
92NG083.2    -----C-------------C--T--C------A---C-A-A------------   5862
90CF056.1    -----A------------C-----C-------GA-G--CA----G----------G    5837
92RW009.6    -----C-------T---C---G-C--------A--CA-T---------G------   5835
92NG003.1    -----C------------C-----C-------GA--AC---------------   5841
93BR029.4    -----C-----------------------------------   5852
94CY032.3    -----C------------C-----C---------C----AT------------G    5867
96ZM651.8    -----C----------------C-----C--------A-----T---C-----------   5834
96ZM751.3    -----C---------------C-----C--------A-G---T--------------   5854
94CY017.41   -----C---------------C-----C--------A--AAC---------------   5857
94IN476.104  -----C---------------C-----C--------GA-G-A-T-A-T-------   5825

93BR020.1    AGGTTTAATATGTGGGAAAATAACATGGTAGAACAAATGCATACAGATATAATCAGTTTA    5888
92NG083.2    -AT----C-----A-G-----------------G----GGAG-----------   5922
90CF056.1    --C---------------G--G--G-------------C-----------   5897
92RW009.6    GA-----C-----A-----------------G--G-----------------C--   5895
92NG003.1    -CT----C-----A-----------------G-----GAG------------   5901
93BR029.4    -AT---G--------A----------------------------------   5912
94CY032.3    -AC-----C-----A----G----------G-----GAG-------------   5927
96ZM651.8    -AT----C-----A----G-------G--T--G-----GAG------------   5894
96ZM751.3    -A------C----------------G--T--G-----GAG-----------   5914
94CY017.41   -AT---------A--------------G--G-----AGA------------C---   5917
94IN476.104  -AT----C-----A----G------G--T--G-----GAG---G--------,--   5885

93BR020.1    TGGGATCAAAGCCTAAAGCCATGTGTGAAGTTAACCCCACTCTGTGTTACTTTAGATTGT    5948
92NG083.2    -----GG-----------------A---C----T--T------A-C------A-C---    5982
90CF056.1    -----------T-G--A-------A--A------------------C--A-C---    5957
92RW009.6    -----C-------------------A------------T-----C---------G---    5955
92NG003.1    ------G------------------A---C-------T-------------C---A-C---   5961
93BR029.4    ------------G----------------------------------CG---A---    5972
94CY032.3    ---A--G--G--------A-------CA---C-----T-T------------TACA---    5987
96ZM651.8    -------------------------A-----G-------------C------A-----    5954
96ZM751.3    -----C-------------------A-----G-------------C------A-C---    5974
94CY017.41   -----------------------A--A--------G-----C--C-T----A-----    5977
94IN476.104  ------------------------A-----G-------------C------A-C---    5945

93BR020.1    AGAAACATTGCCACCAATGGCACCAATGACACTATT............GCCATCAATGAC   5996
92NG083.2    -CT--TG-AAA--GTGC-AATCAT-C---G.........GC----A--            6021
90CF056.1    -CT--TG-CAGA-A----AC-T-T--CAG..............--C-AG-          5993
92RW009.6    -AC-----CA---ATGTCAA--A--C-T...............---CATT         5991
92NG003.1    -CT--TG-CAATGT--CA-T-ATGTGAC--GC-C-GGGAACAGTGCT-GG-C---C-CT    6021
93BR029.4    --T--TGCCA-T------CA-T--TC-AA-..............-G-CAC-         6008
94CY032.3    -TT--TGCAA-T--T-C-AAT-GT-CCA...............-T               6017
96ZM651.8    -C-G-GG--AATGTT-CCA-A--ATGT-A-T-A--GCGTGGTTAATAATA---CA----TT  6014
96ZM751.3    -CTGCT-A-ATA-----CAATG-T---ATA--C-AC........AAT--T-AT-TAAC-   6025
94CY017.41   --C--TGCCAAT----GCAC-CAT-GCA-T-G........-----GT-GCAC-       6019
94IN476.104  --T--GG--A--.....-AATG-T-C.................                5969
```

Fig. 13Q

```
93BR020.1    ACTCTGAAGGAAGATCCAGAGGCAA...TACAAAACTGTTCTTTCAATACAACCACAGAA    6053
92NG083.2    ---G-AG-AA-CA-AGA---AAT-......A-------C--------G-T----------    6075
90CF056.1    -G-A--G---C--GAGGG  ACT-......AC---T--C---------GT---T----T-    6047
92RW009.6    --GGATG-CATGA-AGG---AAT-......A-------C----------TG---------    6045
92NG003.1    --GTGT--CAT---AGA--CAAAC-ACT--A-------C----------T----------    6081
93BR029.4    CTGAA-G-A--GCCAGGG-CAAT-.....................-TG-------------    6062
94CY032.3    GGCACTGT-ATTA-AGA--GAAT-......A-------C------G---T----------    6071
96ZM651.8    -A-AAT-GCATGA--GG---CATG......A----T--C---------C-T----------    6068
96ZM751.3    -ACTAT--TA-T--AA-T-CATG......AG---T--C----------T------------    6079
94CY017.41   CAGAGCCCCATTA--GA---AAT-......A-------C--A-------T------AT-    6073
94IN476.104  ...TAC--TA-TAC-GAT--TAT-......A----T--C-------T---G----------    6020

93BR020.1    ATAAGAGATAAGCAGCTGAAAGTACATGCACTTTTTTATAAACTTGATATAGTACAAATC    6113
92NG083.2    -GGG---GC---A--AA-G---A-T-C--G-----C------------G-G----C---T    6135
90CF056.1    C-----------------A------------------C-------G-------C---T    6107
92RW009.6    T----G------A-A-A--G---GT--T-----------GG---------------T    6105
92NG003.1    ------------A-AAA--C--A-T----G-----C----G-------G-G----C----    6141
93BR029.4    G------------------------------------GG--------------------    6122
94CY032.3    -----G-------A--AA-----A-T---G-----C----G-A---------G-C---T    6131
96ZM651.8    C---A-------A-AAA---T--GT----------------------------TC-C-T    6128
96ZM751.3    T---------AG-AG-C-----G-------C-----------------------C---T    6139
94CY017.41   C----------ACA-AA-----TT--T----G-------G-------G--------C-T    6133
94IN476.104  -------C---A-A-GC----AGT-------G-------G---C----------C-C-A    6080

93BR020.1    AA......CAAGGATGAC................................AATAGAACATA    6136
92NG083.2    -G......T--T-GGA-T...........................G-CT-GT--    6158
90CF056.1    G-......T--CA--A.............................G--CTCAG--    6127
92RW009.6    --......T-GCA--AGTAATAACAGT..................AGTC---ATCAG--    6140
92NG003.1    G-......TGGTA--A-TAAT.......................GTCTCA-AT-AC--    6170
93BR029.4    -G......---T---A-TAGTAGCAATGATAAT.............AGT-GC---GA--    6163
94CY032.3    --......TGCTAG.AGTGCCAATTAATGGTAGTAATAGGAATAATAGT-CAGA-GAG--    6184
96ZM651.8    --......TG-AC----GACTCTGAGACTGGCAACT..........CT-G--A-TAT--    6172
96ZM751.3    --......TG--A--..............................TCC--TGA---    6159
94CY017.41   G-TGAAAGTG-AA--A-GAATA.CATCAGG.................TAGT----CTCTG--    6177
94IN476.104  --......TG--A--A-GAACAGCTCTAGT.................AACT----TGAG--    6118

93BR020.1    CAGACTAATAAATTGTGATGCCTCAACCATTACACAGGCTTGTCCAAAGGTATCTTGGGA    6196
92NG083.2    T--G------C-----A---T----------A----------------AA--TT--    6218
90CF056.1    T--G------------A--A-----GT---------------C--------G--C-TT--    6187
92RW009.6    T--GT---------A--A---C-----------------------------C-TT--    6200
92NG003.1    T--G------------A--A-T----------A---A-----------G---TT--    6230
93BR029.4    ---G------------A--A-------C-------------------------------    6223
94CY032.3    T-TGT---------A-C------------A---------C-------G----TT--    6244
96ZM651.8    T---T---------A--A-----G--C-A-----A--C----------C----TT--    6232
96ZM751.3    T---T---------A--A----GG----A------A-----------TA---TT--    6219
94CY017.41   T-------------A--A----------C------A--G-----------A-C-TT--    6237
94IN476.104  --T-T---------A--A---------A-----A--C----------C----TT--    6178

93BR020.1    TCCAATTCCCATACATTATTGTGCTCCAGCTGGTTATGCGATTCTAAAGTGTAATGAGAA    6256
92NG083.2    C----------------------------T-------T---------GG--T--    6278
90CF056.1    A--T------------------------C-T----------------CA-T--    6247
92RW009.6    G----------A-------C---------TC----------------A--T--    6260
92NG003.1    C--C-------------------------G-T------T---------GG-GT--    6290
93BR029.4    ---------------------------G-------------------T--    6283
94CY032.3    G-----------------C---------T---A---T--------------    6304
96ZM651.8    C-------T-----------------------------------------A-T--    6292
96ZM751.3    C-----C--T----------------------------------------CA-T--    6279
94CY017.41   G--------T----------------C--------T-----------G--TCC    6297
94IN476.104  C--------T-------------------T-----------------A--TG-    6238

93BR020.1    AAATTTCACAGGGACAGGGTCATGCAAGAATGTCAGTACAGTACAATGTACACATGGAAT    6316
92NG083.2    GG-G-A--AT--A-----AC----T--A-------------------------------    6338
90CF056.1    --CA----AT-A------A-T---T-CA-------------------------------    6307
92RW009.6    --G-----AT--A------C---------------C---------------C---------    6320
92NG003.1    G--------T--A-----ACA---T--A---------T---------------------    6350
93BR029.4    ---A----AT-----G---C------G-------C-----------------------    6343
94CY032.3    ---------T--ATT----C------CA-------CT-G----G----C--T--------    6364
96ZM651.8    G-CA----AT--------AC-----C-T-----C----------------------    6352
96ZM751.3    G-CA----AT--A-----AC--------T-------C-----------------------    6339
94CY017.41   G-GA----AT--A------------------T--CT------------------    6357
94IN476.104  G-CA----AT--------AC--------G-G-----------------------    6298
```

Fig. 13R

```
93BR020.1   TAAACCAGTGGTATCCACTCAATTGTTGTTAAATGGCAGCCTAGCAGAAG...GAGAGAT   6373
92NG083.2   ---G-------------A------C-AC--C-G--------TT----------...A---T--   6395
90CF056.1   --G------------A------C--C-A---------A--------------...A-C----   6364
92RW009.6   C--G-----A-----A-----GC--C--------------T-----------...A------   6377
92NG003.1   ------------A--------AC-AC-------T--T---------------....---A--   6407
93BR029.4   --------------A-----------------------------------A...A---T--    6400
94CY032.3   ---G-----------A------C----------A---T-----ACG-...A----G-    6421
96ZM651.8   ---G-----------A------C-AC----------T---------...A--G---    6409
96ZM751.3   ---G-----A-----A------AC------T--T-----------...A------    6396
94CY017.41  --------A-C---A------C--C---G---------T---------GAG-GA-A--   6417
94IN476.104 ---G-----------A------C-AC----------T---AC------A...A------   6355

93BR020.1   AGTAATCAGATCTCAAAATATCTCAGATAATGCAAAAACCATAATAGTGCACCTTAATGA   6433
92NG083.2   -AG---T------G-----T--A----C---A-C---GT-----------G------A-   6455
90CF056.1   CA----T--A--A--------------C--A-C----A---------A--G-----GAC   6424
92RW009.6   -A----T------G--------TA--A-C-----C----------A--A----C--    6437
92NG003.1   ------T------G----CC--A----C-----C---GT---------A--G-----A-   6467
93BR029.4   -A-----------------------------------------A--A-------T    6460
94CY032.3   ------T--------A------C--A-C----AT--------A--G--GCAA-    6481
96ZM651.8   -A----T------G-----C-GA--A-C----TC------A-------A--T------AG   6469
96ZM751.3   -A----T------A--------GA----C-----C----TA--------A--T--------   6456
94CY017.41  -A-G--T------G--------TA--A-C-----C----A---------T--GT---C-A-   6477
94IN476.104 -A---CT-----------AA----C-----------T--------A--T--------   6415

93BR020.1   ATCTGTACAGATTAATTGTACAAGACCCAACAACAATACAAGAAAAAGAATATCTTTAGG   6493
92NG083.2   TAG-A--G-A----------TC--------T-------------------T---C-AA--C-   6515
90CF056.1   -C-A---A-C----CA-----C--G--T-----T----G----C---T---CA-----   6484
92RW009.6   GA------A---------T-C-----T------------------TG--CA-A----   6497
92NG003.1   -A--A--GGA--------C-------------------------T--AGAA-C--   6527
93BR029.4   ------G-C-----------------------------------T---C-AA----   6520
94CY032.3   GG-----A-A-------------C-----TGG--------------------TG--CA-A----   6541
96ZM651.8   ----A--G-A---GTG---GT-----------T---------C----T---AGAA----   6529
96ZM751.3   -------G-A---GTG----------------T--------G-----TG-GAGGA----   6516
94CY017.41  GC------TA----C----TC--------------------------T---CGC--T-    6537
94IN476.104 ---CA--A-A---GTA--------------T--C-----------T---AGGA----   6475

93BR020.1   ACCAGGACGAGTATTTTATACAACAGGAGAAATAATAGGAGACATCAGAAAGGCACATTG   6553
92NG083.2   --------A--CG--C---G-------T--T------------------A---C-A--------   6575
90CF056.1   G---------C----C---G-------T--C--C--------T--A---C-A-------   6544
92RW009.6   --------A--C------G--------T--CG------G--T--A----C-A---T----   6557
92NG003.1   ---T----A--CG--C---G-------T-----------------C-A..........   6570
93BR029.4   --------C-------------------------------------------------   6580
94CY032.3   G-------T-AC--GG---G-------T--------------T--A---C-A-------   6601
96ZM651.8   --------A-AC--C---G-----------C--------------A---C-A-------   6589
96ZM751.3   --------A-AC---C---G----------------A-T--A---C-A---T----   6576
94CY017.41  --------A--CC--C--------AT-A...------G-----A---C-A-------   6594
94IN476.104 G-------A--C--C---G-----AAC-GC-------------A---C-A-------   6535

93BR020.1   TAACGTTAGTGGAACACAATGGAGGAACACGTTAGCAAAGGTAAAGGCAAAGTTAGGGTC   6613
92NG083.2   ---T------A---T-A--------G-G-T----AAG--T--C-CA---C--C--A--AA   6635
90CF056.1   ---TA-----A-----G-C----AT--G--T---CACC-----GTTA--C-A-----AAT   6604
92RW009.6   --CT--C-A-------A------AT-GA--T--CA--------GCA-A---A---A-TCA   6617
92NG003.1   ............G----CA-G-G-T-----CAG------C----C-AC---AACA   6614
93BR029.4   ---------------A------ATG-G-----A--------G-----------AA-C-   6640
94CY032.3   ----A---------ATG-T----ATG----C---AA-GT-A---GT-A-G-A--GAAAAG   6661
96ZM651.8   ----A----A-G--TA-C----CT--G--T---CG-G------G-AAC--A---A-AGA   6649
96ZM751.3   ----A-C----A-GGCA------AT-----TC--CA--G----GGT-A---A--A-AAA   6636
94CY017.41  ---TA-C-ACAA----TT-----ATG----T---CA-------GCT-A-C-A--A-AGA   6654
94IN476.104 ----A------A-T-TA-C---CT--A--T---CA-G-----GGAAA---A----CAAA   6595

93BR020.1   TTATTTCCCTAAT...GCAACAATAAAATTTAACTCATCCTCAGGAGGGGACCTAGAAAT   6670
92NG083.2   AATC-ATAA----...AAG-AC----CC-----------TG---------------    6692
90CF056.1   AC-C--GAAC---...AG--------GC--AA------------A-G---G-    6661
92RW009.6   C--C--TGAG--CATTA--------TT-----GAAC--------G-----TT------    6677
92NG003.1   GGTC--TAAC--.......GT----CC-----------G-----------------    6668
93BR029.4   -C----------.,..---------------------------------------    6697
94CY032.3   ACTC----------...AA---------------GCTC--C--GT------------    6718
96ZM651.8   AC-C----------...AA--AC----C------AC-----------------    6706
96ZM751.3   A--C----------...AA--------GC---GCAC-----------------    6693
94CY017.41  GA-A--------G...AA---C----TC----CTAAC--------------C------    6711
94IN476.104 GC-C----------...AA------GT--C---CA--------------------    6652
```

Fig. 13S

```
93BR020.1   TACAAGGCATAATTTTAATTGTATGGGAGAATTTTTCTACTGTAATACAGATGAACTGTT   6730
92NG083.2   -----CA----G---C-------GA-----G--------T--C------TCA-G-----   6752
90CF056.1   --G--CA----G--------------GA---------------T--C------TCA-GG-----   6721
92RW009.6   -----CA----G------------GGA--------------T-------TCA-GCT----   6737
92NG003.1   -----CA----G----------GA--------------T-------TCA-G-T----   6728
93BR029.4   ----T-----G-----------GA--------------C------TCA-G----    6757
94CY032.3   -----CA----GC-------AA--------------T--C------ACACC------   6778
96ZM651.8   -----CA----GC---------GA---------------T--C------TCG-GC-----   6766
96ZM751.3   -----CA----GC---------GA---------------T--C------TCAA------   6753
94CY017.41  -----CA-T--G---------GCA--------------T--C------ACA-GC-----   6771
94IN476.104 -GT--CA----GC---------GGA--------C--T--T---------TCAAG------   6712

93BR020.1   TAATGACACAAAATTC...AAT...GACACAGGATTCAATGCC.................   6767
92NG083.2   ----A-T-AT-TTAGTAAT-T-...A-T-AT-AG.........................   6783
90CF056.1   ----AGT-GTTGGGAAATGC--...ACT-ATTACACATCAAATGACACAAAGGGAAACGA   6778
92RW009.6   ----AG---CTGGAGTAAA-GA...A-TGGCACC-GGC-GTCAAATGGCACAGAATTA...  6792
92NG003.1   -----AT--GG-GGGAATG--...AC---.............................   6755
93BR029.4   ---------GT-GA-AATGGC.......................................   6779
94CY032.3   ----AGT---C-CA-GCAA---...-GT---AACA-T-CAA-TACAGATTCTACAAATTC   6835
96ZM651.8   --G-ATA-ATT-TACAGAA-----...A-T----ATGGT-CAC.................   6804
96ZM751.3   -----GT--GTTTAATGGT-CA...A----TTCTAATG--A-AAGTAATTCG........   6802
94CY017.41  -----GT--GTGG-GGAAC---...-GT--GT-GAA-GGGCC-TACACACCTAATAACAC   6828
94IN476.104 ---C-GT--T-CAATGGT-CAGACATGC-TAC--A------TACAAATTCCAGTTCAGA   6772

93BR020.1   .......ACTATCACTCTCCCATGTCGAATAAAACAAATTGTAAACATGTGGCAGGAAGT   6820
92NG083.2   .........----- -A---------AA---------------G-GG---------A----   6836
90CF056.1   A......AC--T--A--G-----CA--------------------------AG----   6832
92RW009.6   ........-A---A--A-------CA-------G-------A----T---------AGGAC  6845
92NG003.1   .........-----A------ AAG--------------G-GA---------AG---   6806
93BR029.4   .................----------G-----------T-----------------   6832
94CY032.3   A.......--C-----A----A----CA--C--------T------GG---------   6889
96ZM651.8   ........-C----A--------CA------G-------A----T-----------   6856
96ZM751.3   ........-C--T-G--T-A---CA-------------AC------------GG-   6855
94CY017.41  CAATGGA-G---A-TC-------CA--------A------------AG+--   6888
94IN476.104 C......-TC----TG--T-----CA------GG--T--A-------T------A-G--   6826

93BR020.1   GGGACGAGCAATGTATGCCAATCCCATTGCAGGAAACATTACCTGTAACTCAAATATTAC   6880
92NG083.2   -----A-------------CT------C---------C--GTA----A-----C-----   6896
90CF056.1   A----------------CC------CCA----------TG---GTA-----------   6892
92RW009.6   A----A-------------CC------CCA----GTA--A-G---GTA-----C-----   6905
92NG003.1   -----A-------------CC------C-----G-T-----A----GA-----C-----   6866
93BR029.4   ---G---------------GC----------------------G-------------   6892
94CY032.3   ---G-A--------C---TCC----------G-G-----A---C-G----G-------   6949
96ZM651.8   A------------C---CC------A---------AG-A------A---G----C----   6916
96ZM751.3   A----A--------TCC---A---AA--------A--A------A---------C--   6915
94CY017.41  A---A-------------CC-------------TA--A-AG----CA-----C-----   6948
94IN476.104 A-----------------CC---------A-------A--A---G-A--------C-+   6886

93BR020.1   AGGTCTGCTATTGACAAGAGATGGTGGT........CTG.......AATAGTACTAATGA   6925
92NG083.2   ---AT-AA----A--------------G.........AATAACAATG-C-----AG-G--   6947
90CF056.1   ---A--AA---------TT--C-AG---........AACG...CGTC-GCAGAA---T-   6940
92RW009.6   ---A--A---------A-......-A........AATA...AT----C---A-C---    6953
92NG003.1   ---G--AT----A--------------G.........GTTA...AT----C-GGA-----   6914
93BR029.4   ------A---------------------.........-A-AA....T---CAG--GG-G--   6940
94CY032.3   ---AA-AA---------------------.........-----------C---A--A--C---   6991
96ZM651.8   ---G--A------GTTC-G------A---AAGCACAAATGATAGCACA----A--AC-CA--   6976
96ZM751.3   ---A--A-----A---C-T-----A--G.........ACAAATGAC-CAGAG--ACCA--   6966
94CY017.41  ---AA-AA--------------------------AAC---G-G-----    6993
94IN476.104 ---A--A-----AGT-C-T-----A--C........GACA...CA-------GC-CA--   6934

93BR020.1   GACCTTCAGACCTGGGGGAGGAAATATGAAAGACAATTGGAGAAGTGAATTATATAAATA   6985
92NG083.2   --------------A---G------GG------------------G--    7007
90CF056.1   T-----------A---G------GG------------------G-------    7000
92RW009.6   A-----------A------G------GG--T----------C---------    7013
92NG003.1   --------------A---G------GG------------------G--    6974
93BR029.4   ------------------------C------------------    7000
94CY032.3   --T--------A----- G-C----GG----------C --------    7051
96ZM651.8   --TA---------CA----G----GG----------G--------G-----G--   7036
96ZM751.3   ---A----------A---G-C----GG-------------------    7026
94CY017.41  -------------A---G-----GG--------------------    7053
94IN476.104 --TA-----------A------G-----GG----------------------    6994
```

Fig. 13T

```
93BR020.1   TAAAGTAGTAGAAATTGAACCACTAGGAGTAGCACCCACCAAGGCAAAAAGACAAGTGGT  7045
92NG083.2   ----AC----A----CA--T-----------------------G-----GG---AG-----  7067
90CF056.1   ----------A--------------G--A-------------A---GG---AG-----  7060
92RW009.6   ----------A---------------------------G-----G--GAG-----  7073
92NG003.1   ----A-----A-----A----------A-------------------GG---AG-----  7034
93BR029.4   ------------G---T------------------------------------------  7060
94CY032.3   ----------A-G--------A-----------AT------GG----G-----  7111
96ZM651.8   ------G---------A-G--T-G---A---------TG----------GAG-----  7096
96ZM751.3   ------G---------A-G--T-----------------T----CG---GAG-----  7086
94CY017.41  ----------A--C----------------T----G---------AC-----  7113
94IN476.104 ------G---------A-G---T-----A---  ---T--TG-A-----  --GAG-----  7054

93BR020.1   GAAGAGAGAAAGAAGAGCAGTGGGACTAGGAGCTCTGTTCCTTGGGTTCTTGGGAGCAGC  7105
92NG083.2   -G--------A-----------T-----G------G-C-------------A--------  7127
90CF056.1   -G--------A-------------A-G------TCT-----------------------  7120
92RW009.6   -G--------A-----------T-----G------G-C--A----------A--------  7133
92NG003.1   -G--------G--A---G------T-----G------G-C------------A--------  7094
93BR029.4   ----------A---------------A-G------T-----------------------  7120
94CY032.3   -C--------A-T------------A----G--CA-------------------  7171
96ZM651.8   -G--------A------------------A-----G-----------------------  7156
96ZM751.3   -G--------A----------A---A-     --G--    ----------------  7146
94CY017.41  -G--------A---------T-----G------G-C-----------------------  7173
94IN476.104 -G--------A---------------A-------G------------------T---  7114

93BR020.1   TGGAAGCACTATGGGCGCGGCGTCAATAACGCTGACGGTACAGGCCAGACAATTATTGTC  7165
92NG083.2   A--G-------------------------C-----T---------------  7187
90CF056.1   A-----------------------------------G----------  7180
92RW009.6   A---------------------------------------------  7193
92NG003.1   A---------------G-------------------T---------------  7154
93BR029.4   A---------------A-------------------C---------------  7180
94CY032.3   A---------------A-----------G---------------------  7231
96ZM651.8   A---------------A-----------C--------------G-G--,--  7216
96ZM751.3   A---------------A--A------------------T---------------  7206
94CY017.41  A-------------------------C------------------------  7233
94IN476.104 A---------------G-------------------------G-----  7174

93BR020.1   TGGAATAGTGCAACAGCAGAGCAATCTGCTGAGGGCTATTGAAGCGCAACAGCATCTGTT  7225
92NG083.2   ---C----------------A------T---------A--G-----G-----------  7247
90CF056.1   ---T--------G-----A------T---------A-----AC-G----G------A----  7240
92RW009.6   ---C----------------A------T---------A-G--T-----------A--  7253
92NG003.1   ---C----------------A------T---------A-G----G--A-----A--  7214
93BR029.4   ---C---------------AT---T---------------------------  7240
94CY032.3   C--C--------G-----------T-----------A--G--T-----A--------  7291
96ZM651.8   ---T----------------A------T---------A--G-----------------  7276
96ZM751.3   ---T----------------A------T---------A--G-----------CA----  7266
94CY017.41  ---T----------------A------T-----CA-  --A-----T ------------  7293
94IN476.104 ---T----------------A------T------A------A--G------------A---  7234

93BR020.1   GCAGCTCACAGTCTGGGGCATTAAACAGCTCCAGGCAAGAGTCCTGGCTGTGGAAAGATA  7285
92NG083.2   ---A-------------------------T---------------A-A--------  7307
90CF056.1   ---------G---------------------C-----------  7300
92RW009.6   AA-A-----------------------------------C----------  7313
92NG003.1   ---A---------------------------------------A----------  7274
93BR029.4   ---------------------------------A--------------------  7300
94CY032.3   -AGA-----G-------------------------------C-------C--  7351
96ZM651.8   ---A-----G------------G--------A--------------A-A---  7336
96ZM751.3   ---A---------------G---------T-----A-A--------  7326
94CY017.41  -A-A-------------------------G--G------------------  7353
94IN476.104 ---A---------------G--------A-----T-----A-A--G-----  7294

93BR020.1   CCTAAAGGATCAACAGCTCCTAGGGCTTTGGGGCTGCTCTGGAAAACTCATCTGCACCAC  7345
92NG083.2   -----------------------A-----------------------------------  7367
90CF056.1   -----G-------------G---A-----------------------------------  7360
92RW009.6   -----G-----------------AA----------------------------------  7373
92NG003.1   -----------------------A-----------------------------------  7334
93BR029.4   -----------------------------------A-----------------------  7360
94CY032.3   -----------------------AA----------------------------------  7411
96ZM651.8   -----------------------A-----------------------------------  7396
96ZM751.3   -----------------------A-----------------------------------  7386
94CY017.41  -----------------G--AA-------------------------------G----  7413
94IN476.104 -----------------------A---------------------G--------C----  7354
```

Fig. 13U

```
93BR020.1    TAATGTGCCCTGGAACTCTAGTTGCAGTAATAAATCTCTTCAGGAGATTTGGGGGAACAT    7405
92NG083.2    ---------------------A-------------TA-A-T----------AT-----    7427
90CF056.1    ---------T------------------------A-AGAGT--A--C----AC-----    7420
92RW009.6    ------------------------------GA---AGC----A--A-----AT-----    7433
92NG003.1    ---------T------A-----------------TA---------------AT-----    7394
93BR029.4    -G-----------------------C-------AG---A----C--------------    7420
94CY032.3    -------A--T----------------------TA-A-T--T--A----AC--T--    7471
96ZM651.8    -GC------T------ATC---------------AAAACA--T------AT-----    7456
96ZM751.3    -GC------T--------------C--C------GAACG----------AT-----    7446
94CY017.41   --C----------A-----------------G----AG--T--------AC-----    7473
94IN476.104  -GC------T--------C--C------------AAAA-T--T------AAT-----    7414

93BR020.1    GACCTGGATGGAGTGGGAAAAAGAGGTTAGCAATTACTCAAAAGAAATATACAGGTTAAT    7465
92NG083.2    ---T---C-A--A-------GG--AA--CA--------A--C--C-C-------CC-G--    7487
90CF056.1    ---T--------A----T--C-AA---------A--G-G-------------GC-    7480
92RW009.6    ------CA-C-A-----T-----AA--G--------A--C--AT------T--TC----    7493
92NG003.1    ----------AC-A------GG--A--C----------A--C--C-----------CC----    7454
93BR029.4    ----------------------A-----------C-------T---------    7480
94CY032.3    -------T--C-A----T-----AA---A-------A--C--AT------TG-----C-    7531
96ZM651.8    ----------C--------T-G---AA----T------A----CAC----------GC-    7516
96ZM751.3    ----------C--------T-G---AA--AT-----A--G--CAT-----T---GC-    7506
94CY017.41   -------T--C-A-----T-----AA--------A-----CAT------T-----C-    7533
94IN476.104  ----------C--------T------A----T------A---CAC-------C--GC-    7474

93BR020.1    TGAAGACTCGCAGAACCAGCAGGAAAAGAATGAACAAGAATTATTAGCATTGGACAAATG    7525
92NG083.2    ------A---------------------------C-----G------------G--    7547
90CF056.1    -----T------A-C------------------G--C---------------    7540
92RW009.6    ------A--------------------------C-----G-----------G--    7553
92NG003.1    ------A--------------------------C-----G-----------G--    7514
93BR029.4    -----G------------------------------G----------------    7540
94CY032.3    ------A-A-----------------G----C----G--C---------G--    7591
96ZM651.8    ---G---------G-----------GC-A-----A----T--------------GT--    7576
96ZM751.3    -----T------A---------------T------AGG--T---C-----------GT--    7566
94CY017.41   ------A-----A-----------------G-----C----G-----A----    7593
94IN476.104  ------A-----A-T---------C-A----G-A---T-----------GT--    7534

93BR020.1    GGCAAGTCTGTGGAATTGGTTTGACATAACACAGTGGCTGTGGTATATAAAAATATTCAT    7585
92NG083.2    ------T-----------------T--A-T-----A----------G---------    7607
90CF056.1    ------------C------------T---T---------------------    7600
92RW009.6    -----A-----------------T--A-T------------------------    7613
92NG003.1    ------T-----C-----------A-A-----A------------------T--    7574
93BR029.4    -----------------------T--A-A----------------------    7600
94CY032.3    ------C-----------AG------A-A-----A---------------T--    7651
96ZM651.8    -AAC-A--------------------A-A---------------------T--    7636
96ZM751.3    AAA--A--------------A-T------A-T----------------    7626
94CY017.41   ----GA-T------G------CA----TT----C----------G------T--    7653
94IN476.104  -CA--A-------------AG------A-A-----------------    7594

93BR020.1    AATGATAGTAGGAGGCTTGATAGGCTTAAGAATAGTTTTTACTGTGCTTTCTATAGTAAA    7645
92NG083.2    ---------------T--A-----T--------G-------------    7667
90CF056.1    ---------------T--A------T--------A-----G-------------    7660
92RW009.6    ----------------A---T--------A-----G-------C--------G--    7673
92NG003.1    ---------------T--A-----T--------G-------------    7634
93BR029.4    ---------------------A-----G------------------    7660
94CY032.3    -------------------A----G------------------    7711
96ZM651.8    -----------A----T--G-----A-----G----A--C-------G--    7696
96ZM751.3    ---------A------------T---------A-----G------C-------    7686
94CY017.41   ----------------A--------------G--A-AA--A--G-------    7713
94IN476.104  ---T-----------------T--G-----A----G-------A--------    7654

→TAT/REV 2nd exon start
93BR020.1    TAGAGTTAGGAAGGGATACTCACCTTTGTCATTTCAG ACCCATATCCCAAGCCCGAGG...   7703
92NG083.2    ----------C---------------G--C--- ----T--C--ATCA--A-C--..   7725
90CF056.1    ----------C---------T------  ----T-G----G-A---AC--..   7718
92RW009.6    C---------C--------A--A--G--- ----T---------A-----..   7731
92NG003.1    ----------C-----------------C--- ----T--C--ACCA--A-----..   7692
93BR029.4    -----------------------A--- ----GCT----------A----..   7718
94CY032.3    ----------C-----------T--G--- ----T---------CAA--CCAACG   7771
96ZM651.8    ----------C-----------G----- ----T------G-A--A---..   7754
96ZM751.3    ----------C--G-------G--G--- ----T---------C--------..   7744
94CY017.41   ----------C-----------G----- -T--C--C---------AGA-..   7771
94IN476.104  ----------C-----------G--G-- ----T--C----GA--------..   7712
```

Fig. 13V

```
93BR020.1    .GAACCCGACAGGCCCGAAGGAATCGAAGAAGGAGGTGGAGAGCAAGGCAAAGACAGATC              7762
92NG083.2    .-----------T--G-AA--C--------------C-------A--G---------              7784
90CF056.1    .-G-------------CA--------------C-------A--G-------                    7777
92RW009.6    .-G---------T--G-------------A----------A--G--G------                  7790
92NG003.1    .-------------A-------------------------A--G---------                  7751
93BR029.4    .--------------------------------C------------------                   7777
94CY032.3    G-G--T--------G-----CA------A-------C-------A--G-AG------              7831
96ZM651.8    .------------A-G-A----------A---------------A------G-----              7813
96ZM751.3    .----A-------T--G-A---------A--------------A--G---------               7803
94CY017.41   .-CT---------AG----C-----------------------G---------                  7830
94IN476.104  .-----------T-AG-----------A----------------A---------                 7771
                                  TAT 2nd exon end ←
93BR020.1    CGTGAGATTAGTGACCGGATTCTTAGCTCTTGCCTGGGACGACCTGCGGAACCTGTGCCT              7822
92NG083.2    -ACTC---------G-----------G-------------------G----------                 7844
90CF056.1    --------------A---------C-AG---T-----------C----G-----CA--                7837
92RW009.6    -A-TC---------G-----------A-----------------A--G---------                 7850
92NG003.1    A---C-C-------G-----------A-------------------------------                7811
93BR029.4    --------------A--------------T----------------A-----------                7837
94CY032.3    -A-TC-C-------A---------GC-A---AT-------------------------                7891
96ZM651.8    ----C---------G-----------A-------------A---------------                  7873
96ZM751.3    AA-TC---------A-----------A---T---------C----G----------                  7863
94CY017.41   GA-TC---------A---G-----C--A-----------------A----G---------             7890
94IN476.104  -A-TC---------A-----------A-----------------T--A----G ---;----            7831

93BR020.1    CTTCAGCTACCGCCACTTGAGAGACTTCATATTAATTGCAGCGAGGATTGTGGA....CA              7878
92NG083.2    T-- -------A--G-------G-----AG-C--G--------A----CG-----ACTT-T             7904
90CF056.1    -----------T-----------AC-C-----T--T----C------ACTT-T                     7897
92RW009.6    T----------A--GA--------AC----G-----------CG-----ACTT-T                   7910
92NG003.1    -----------A--GA--------AG-C--G-------------CA-CA--ACTC-T                 7871
93BR029.4    ----------------------------------------------------------                7893
94CY032.3    --------------A-----AC-C----T---------C------ACTT-T                       7951
96ZM651.8    -----------A--GA----------------GG-GA-------AGCG-----GCTT-T               7933
96ZM751.3    T----------A--G-----------------G-----------GGAC-AC-......                7917
94CY017.41   ------T----A--G-------T-G-----G-------------C------ACTT-T                 7950
94IN476.104  ----- T -G--A--GA-----------------GG----------AGCG ----ACTT-T             7891

93BR020.1    GGGG..............G.CTGAAGAGGGGTGGGAAGCTCTCAAATATCTGGGGAA                 7921
92NG083.2    ---ACGCAGCAGCCTCAAGG-A----GACT-----------GC-----G--CT--T----              7964
90CF056.1    ----...........-GA------A-------C--------CT----                           7936
92RW009.6    ---ACGCAGCAGTCTCAGGG-A--AC------   A-C--T---G---A--A--                    7970
92NG003.1    -A-ACGCAGCAGTCTCCAGG-A----GACT---------G-GC----------T----                7931
93BR029.4    ----..........A-----------------------C-------CT------                    7936
94CY032.3    -------TA--------------C----G-----T----                                   7990
96ZM651.8    -A-ACGCAGCAGTCTCAAGG-A--AC-------------C-T----G---------A-G               7993
96ZM751.3    ....-............-A---T-G---------G                                       7950
94CY017.41   ---ACACTGCAGTCTCAAGG-A----GACT-----. ----C ---T-GA-----T----              8010
94IN476.104  ---ACGCAGCAGTCTCAGGG-A--AC----------------C-T-G---------A-G               7951
                                           REV 2nd exon end ←        REV 2nd exon end
93BR020.1    TCTCACACAGTATTGGGGTCAGGAACTAAAGAATAGGCTATTAGCTTGCTTAATGCCAC               7981
92NG083.2    C---CTGTT---------------G--------------AT------G--A-A-T                   8024
90CF056.1    ---TCT---A--C-----A-----------------------GAT------CA----                 7996
92RW009.6    ---TGTG-------------T---------A-GG--------ATC-----G--A----                8030
92NG003.1    ----CTGTT---------------G--------------AT---A--G--A-A-T                   7991
93BR029.4    ----G-G-T---------A---------------------------------A----                 7996
94CY032.3    CT--CTG-T---------A-----G-----------------AT---T-----A----                8050
96ZM651.8    ---TGTG-------------T---G-----A--G--------TC-A---G--A---T                 8053
96ZM751.3    ---TGT--------------TA--G-----A--G--------T-------G--A-T-T                8010
94CY017.41   ---TCTGTTA--C-------G-----G-----------------AT--G--A-T-T                  8070
94IN476.104  ---TGTG-------------T---------A--G--------TC-----G--A---T                 8011

93BR020.1    AGCAATAGCAGTAGCTGAGTGGACAGATAGAGTTATAGAAGCTTTGCAAAGAGCTGGTAG             8041
92NG083.2    ----------AC----A-CG---------G--------TAGCA---------TA---                 8084
90CF056.1    ---------------G-A------G-GA------T-ATAG----------T-G--                   8056
92RW009.6    --------T---------AG-A---------G--------TTAA-A------AT-A-C--             8090
92NG003.1    -----------A-C---------G--------TAGCA---G-----T----                       8051
93BR029.4    ---------T-----------G---------------------------G-----                   8056
94CY032.3    ----------------G-A---------AG---------AG-A--G------T----                 8110
96ZM651.8    ----------------AG-A--------GA---------TTAA-A---G--AT-T----              8113
96ZM751.3    ----------------AG-A---------A---------TTAACA-----AT-T----               8070
94CY017.41   ----G------------------------G--------ATAGG---------TTC--                8130
94IN476.104  -------A--A------G-A---------GA--------TT-ACA------AT-T-C--              8071
```

Fig. 13W

```
                                                              ENV end
93BR020.1    AGCTATTCTCAACATACCTAGAAGAATAAGACAGGGCTTGGAAAGGGCTTTGCTATAA .   8100
92NG083.2    -------------G------C---G--------A-----A-----A----------- .   8143
90CF056.1    --------C---------------------------T-----AAGC---------TA      8116
92RW009.6    ------CTAT----------C----------------T---GCA--------A---- .   8149
92NG003.1    -----------------------G--------A-----------A------------ .   8110
93BR029.4    ----G----T---G-------------------------------------------- .   8115
94CY032.3    -------TG--------------------C---------C-T-----A--------T--- . 8169
96ZM651.8    ------C-G--G--------------------T----CA------------- .          8172
96ZM751.3    ------C-G--G---------------------T---GCA--------A----G.        8129
94CY017.41   --------------------------------C--------A----------A------ . 8189
94IN476.104  ------C-G-------------------- ----T--T---GCA------------- .   8130
              → NEF start
93BR020.1    ATGGGTGGCAAGTGGTCAAAAAGTAGTATAGTTGGATGGCCTGCTATAAGGGAAAGAATG   8160
92NG083.2    -----G----------------------C------------CAG----------A        8203
90CF056.1    -----A-----A-------------G--G-G--G---T--A-------------------   8176
92RW009.6    -----AA-------------T-----CC---A-----------G-----A------C-A    8209
92NG003.1    --A-A---------------------C---------------C--GG-------G-----A  8170
93BR029.4    -----A-----------------------------G----------------------T-A  8175
94CY032.3    -----A-----A--------------C------------------AG-------------   8229
96ZM651.8    -----G--------------C--------------------G----A--G-----A      8232
96ZM751.3    -----A-------------C-C-------------------AAAG----A---------A  8189
94CY017.41   -----G-------------G--C---CCA----------------T-----G------    8249
94IN476.104  -----GA-----AT--------C--A---------------AGG----A----------   8190

93BR020.1    AGGCGAACCCCTCCAA...CCC.....................C...TCCAGCAGCAGAG   8193
92NG083.2    --A-A---T---GT-G...-A........................----A            8227
90CF056.1    ------G-TGAA---G...TA........................-----A           8200
92RW009.6    ----A---TGAG---G...-A........................------           8233
92NG003.1    --A-A--------G...-A.........................---A              8191
93BR029.4    --A-A--------G...-A.........................---A              8199
94CY032.3    ------G T-GAG-TGAGC-AGAAAGAATGAGGCGAGCTCAAGCTGAG----------CA  8289
96ZM651.8    --AA----TGAG---G...-A.........................                 8256
96ZM751.3    GCAA----TGA----G...-A.........................--              8213
94CY017.41   --AA--  -T-------CAG-A-AAA......GAACAGAAGCAGTGTC---------CCA  8303
94IN476.104  ---A----TGAG---G...-A.........................                 8214

93BR020.1    GGGGTGGGAGCAGTGTCTCAAGACTTAGAAAGACGGGGGGCAATTACAAGCAGCAATACT   8253
92NG083.2    --A--A--------A---------T----CT--G-AT--A-----C-------------A  8287
90CF056.1    -----A-----------G---T--G--T-----C----G-C----TT-AT-------     8260
92RW009.6    --A--A-------C----------C---C-A-TAT------C------T------C--A   8293
92NG003.1    --A--A-------CAC----------CT--G-AT--A-----C-------------A    8251
93BR029.4    ----------------------------------------------------------     8259
94CY032.3    --A--A------------------G--C-A--AT---------C----TT-A------A   8349
96ZM651.8    --A--A-------C----------T-A-TAT--A---C-------------C--A      8316
96ZM751.3    --A--A-------C----------T-A-TAT-----C----------T--C--A       8273
94CY017.41   --A--A------------------T----CT-CT-AT--A--G-C-------T------A  8363
94IN476.104  --A--A-------CA---------CT-A--AT--A--C------C-------C--A     8274

93BR020.1    AGAGCTAATAATCCTGACTTGGCCTGGCTGGAAGCACAAGAGGAA...GACGAAGTAGGC   8310
92NG083.2    GC-A-C--C--------T-GT-----------------------GGACTCA--T-----   8347
90CF056.1    GC-T---C-----G----TGCC----------------------CGGG--G--------   8320
92RW009.6    CCCAGC--C---G----T-GT---------C-------------GGAAA----------   8353
92NG003.1    GC-CAA-C--------T-GT--------A---------C----GAATTCA--G------  8311
93BR029.4    G------------------------------------G---------...--G------  8316
94CY032.3    GC-----C---------AAAA--------------A--GGAA--A--G-----T        8409
96ZM651.8    --TA-C-C----G---CT-GT----------------G...--A----T---         8373
96ZM751.3    --TA-C-----G----T-GT----------------G-------GGAG-GA--------  8333
94CY017.41   GC-----C---------T-GC-------G-------------A--GGAGAGT-------  8423
94IN476.104  CC-AGC-----G---CTGGT--------C----G---------GGAA--A---------  8334

93BR020.1    TTTCCAGTCAGACCTCAGGTACCTTTAAGACCAATGACCTATAAGGGAGCTGTAGATCTC   8370
92NG083.2    -----G--------A--------G----------T------CT---T-T------       8407
90CF056.1    ----------G-------------------------------T-T------           8380
92RW009.6    ----------------G---------------T-----A-C---A--T------        8413
92NG003.1    ----------AA-----------G----------T------CT--CT-T------       8371
93BR029.4    ------------------------------------T--------C-T------        8376
94CY032.3    ----------G--A---------G----------T---A------T---------      8469
96ZM651.8    ----------------G-------------------T-------C---A--C------   8433
96ZM751.3    ----------------G-------------------T-------TC---AT-T------  8393
94CY017.41   --C-------G--A---------G----------TC--------GT-T------        8483
94IN476.104  -----------------------G----------T-----A-----AT-C------     8394
```

Fig. 13X

```
93BR020.1    AGTCACTTTTTAAAAGAAAAGGGGGGACTGGAAGGGTTAATTTACTCCAAGAGAAGACAA    8430
92NG083.2    --CTT-------------------------T---C-------------------------    8467
90CF056.1    --C--T------------------------T-----------------CA------G    8440
92RW009.6    --CTT-------------------------------------------T----A---G---    8473
92NG003.1    --CTT-------------------------T---C---------T----A-------    8431
93BR029.4    --------------------------------------T-------A-------    8436
94CY032.3    --C---------------------------T---C---------------A-------    8529
96ZM651.8    --CTT---------------------------------------T----A---G---    8493
96ZM751.3    --CTT-------------------------T-------------GT----A-------    8453
94CY017.41   --CTT-------------------------T-----------------C---A-------    8543
94IN476.104  GCCTT-------------------------T-------------T----A---G--T    8454

93BR020.1    GAGATCCTTGATCTGTGGGTCTACCACACACAAGGCTACTTCCCTGATTGGCAGAACTAC    8490
92NG083.2    --C----------A---------TA-T--------A-T-----A---------------    8527
90CF056.1    --C---------T A--------TA------------------C---------------    8500
92RW009.6    --C-----G--T--------TA------------------------------A------    8533
92NG003.1    --C---------C--A-------TA-T--------A---------A---------------    8491
93BR029.4    -----------------------T-----------------------------------    8496
94CY032.3    ------------------------T------------T-T--------------G-T------    8589
96ZM651.8    --A---------T-----------T-----------T---------C-----A-------    8553
96ZM751.3    --A-----C---T-----------T-------------------   ---A ----T    8513
94CY017.41   --C---------A---------------------------------------T---    8603
94IN476.104  --A---------T-A-----T--TA--.                -----A------    8514

93BR020.1    ACACCAGGGCCAGGGATCAGATATCCACTGACCATGGGGTGGTGCTTCAAGCTAGTACCA    8550
92NG083.2    ----------------CT---CTC---------T-T--------------A---------    8587
90CF056.1    ----------------GAG----T---C------T-T-----------------------    8560
92RW009.6    ---------A------G-----------TT-T--A-----T-A----------G---    8593
92NG003.1    --T-------------CT----TC--------AT-TC-------------A---------    8551
93BR029.4    -----------------C--------------T-A-------------------------    8556
94CY032.3    ---------A------GAG----TC------TG T T -A-------------------    8649
96ZM651.8    ---- G--A-----G-------------------T-T--A--------------G---    8613
96ZM751.3    -----G--A-----------------------T-T--A-------A---------G---    8573
94CY017.41   ----------------C---T-A--AT-T--A---------------------:---    8663
94IN476.104  ---------A------G---------------T-T--A-------A---------    8574

93BR020.1    GTTGACCCAGAGGAGGTAGAAAAGGCCAATGAAGGAGAGAACAACTGCTTGCTACACCCC    8610
92NG083.2    A-G-------CA---A----GG-A------A-G----------T-A-TC-AT--------    8647
90CF056.1    --AA-T---C----------C-------------------A-----------    8620
92RW009.6    --------AG---A--G---G-A----------------G----------A--------T    8653
92NG003.1    A-G--T----CA---A----GG-A------A------------------A-T--AT------T    8611
93BR029.4    ----------------------------------------------------------    8616
94CY032.3    --A--T---C-------G---G------C-----------C---T-----G-----T    8709
96ZM651.8    ----T----G---A------G-------C--------A--------TC----------T    8673
96ZM751.3    ---------AG---A------G-A----C--------G-------T----------T    8633
94CY017.41   --A--G---TCT---------G-A--T-C-C-G-----------A----AT-----T    8723
94IN476.104  --------AGT-TA------G-------CA--------A-----------T---------T    8634

93BR020.1    ATGAGCCAACATGGAATGGAGGATGAAGA.CAAAGAAGTACTGAAATGGGAGTTTGACAG    8669
92NG083.2    --CT -G-------------  --G-------G---GT----AGA---A----    8706
90CF056.1    -------TG-------------------C-G.G-G------G----TG---A-A------    8679
92RW009.6    C--------G-------------------G--. --G------CT-A--G---A----------    8712
92NG003.1    --CT----------CC----A----CG--. --G------G--GT----AGA---------    8670
93BR029.4    ---------------------------------G----A-----C-G---AG--------    8675
94CY032.3    --A-----G---------------.G-G-------T-A--G---A----------    8768
96ZM651.8    --------G--A--------T-----TC-.--G-------T-A--G---A--------    8732
96ZM751.3    --A-----G---------A--A---------G-------T-A-GG---A----------    8692
94CY017.41   --AT----------G-A--T--CCCT--.A-G------GT-A-G------------T--    8782
94IN476.104  ------------------T--------.TGG-------T-A--G---C----------    8693

93BR020.1    CCGCTTGGCACTGAGACACATAGCCAGAGAGAGACATCCGGAGTACTACCAAGAC...TG    8726
92NG083.2    TA--C-A----G-------C-----C-----CTG---------------A-----TGC--    8766
90CF056.1    T--AC-A---T---C----T-G---C---TA-AG-----------....--A-----TGC--    8736
92RW009.6    T-A-C-A----AC---------G---C-C---CT----------T--TA------TGC--    8772
92NG003.1    TA--C-A----G---------------ACA---------TA-G---TGC--    8730
93BR029.4    ----C-A---T-TCAT----G--C-----CTG-----------A-G---TGC--    8735
94CY032.3    T---C-----TAC-AG---G-----C-----CTG-----------TT--A-----TGC--    8828
96ZM651.8    T-A-C-A------AT-A------G---C-----CT----------T----A-----TGC--    8792
96ZM751.3    TTC-C-A----GC--------G---C-C---CT-----------T---A------TGC--    8752
94CY017.41   AA--C-----G--------G----C----CTG---------------A-----TGC--    8842
94IN476.104  -A--C-A----GC--------C-C---CT------------T---A-----TGC--    8753
```

Fig. 13Y

```
           NEF end
93BR020.1  AGACTGCTGACACAGAGATTGCTGACACAGAAGAATCT.AAA...GGGACTTTCCA.CTG    8781
92NG083.2  -|..........................----------TTG--G-C-..A----------GC---    8800
90CF056.1  -|..........................----------T.--G---...----------G.---   8767
92RW009.6  -|..........................----------GGA--TTCCGCT-----------.---   8807
92NG003.1  -C--A-AA-T..................----------T-TTG--G-C-A.G--------GC---   8780
93BR029.4  -|..........................--TT--GTTT---.-C-..A----------G.---    8767
94CY032.3  -|..........................----------TTG--G-C-A.A---------GC-C-   8863
96ZM651.8  -|..........................----------GGA--TTCCGCT-----------.---   8827
96ZM751.3  -|..........................----------GGA--TTCCGCT-----------.---   8787
94CY017.41 -|..........................----------TTG--G-CG...----------G.---   8874
94IN476.104 -|..........................-----------.............----------.---   8775

93BR020.1  GGGACTTTCCAGAG...GGTG.GGCCAGAGGGCGGGACTGGGGAGTGGCTCACCCTCAGAT     8838
92NG083.2  ---.---------GAGA--C-C----T-G...-A---G--------------A---------A     8857
90CF056.1  --..--------G-G-.A--C-T-AT-T-G..------GA-----------CA----------   8823
92RW009.6  ---.--GG------G..A----T--T-T-G..---------G-A---------CA---------  8862
92NG003.1  --..--------G-G-.A--C-C---AT-G...-A----------------A---------A    8836
93BR029.4  -------------G-.A----T----T-G..-----------------GAG---------    8824
94CY032.3  ------------G-GA--C-C----T-G..-A---GT------------A---------     8920
96ZM651.8  ---..------G..A----T--T-T-G..----------------TCA----------       8880
96ZM751.3  ---.-G------G-..-----T-AT-T-G..------------------CAG--------A    8842
94CY017.41 -----------G-.A----T--TGT-G..-----AGT-----------A---------       8931
94IN476.104 ---.-G------G...--A-T-T-T-G..--------AT--------TCA----------     8829

93BR020.1  GCTGCATATAAGCAGCCGCTTTTCGCCTGTACTGGGTCTCTCTAGTTAGACCAGATTTGA     8898
92NG083.2  ------------------C---------------------T---G-----------      8917
90CF056.1  --------------T------T--------------T-G-----------C---       8883
92RW009.6  --------------T------T-----------------G-G---------C---      8922
92NG003.1  ------------------C----------------------T---------------    8896
93BR029.4  --------------T----CT------------------G-------------        8884
94CY032.3  --------A--------C--------------------G-----------C---       8980
96ZM651.8  --------------T---------T---------.---------G---------C---   8939
96ZM751.3  --------------T-------------------------G---------C---       8902
94CY017.41 --------------T----C---A---------------T---G---------A.--    8990
94IN476.104 --------------T------------------------G-G--------C---      8889

93BR020.1  GCCCGGGAGCTCTCTGGCTAGCTAGGGAACCCACTGCTTAA.GCCTCAATAAAGCTTGCC    8957
92NG083.2  ---T-------------T-G--AG----------------.-----------------    8976
90CF056.1  ---T-------------A-----------------------.-----------------   8942
92RW009.6  ---T-------------T-----------------------.-----------------   8981
92NG003.1  ---T-------------AG----------------------.-----------------   8955
93BR029.4  ---T-------------------T-----------------.-----------------   8943
94CY032.3  ---T-------------------------------------.-----------------   9039
96ZM651.8  ---T-------------T-----------------------.-----------------   8998
96ZM751.3  ---------------T-------------------------.-----------------   8961
94CY017.41 -----------------AG----------------------.-----------------   9049
94IN476.104 -----------------C---T-------------------.-----------------   8948

93BR020.1  TTGAG...TGC.TTT    8968 (SEQ ID NO: 1)
92NG083.2  -----....----.--C   8987 (SEQ ID NO: 2)
90CF056.1  -----....----.---   8953 (SEQ ID NO: 3)
92RW009.6  -----....----.-C-   8992 (SEQ ID NO: 4)
92NG003.1  -----....----.--C   8966 (SEQ ID NO: 5)
93BR029.4  -----....----T-A.   8954 (SEQ ID NO: 6)
94CY032.3  -----....----T-C.   9050 (SEQ ID NO: 7)
96ZM651.8  -----....----TC-.   9009 (SEQ ID NO: 8)
96ZM751.3  -----....----C--.   8972 (SEQ ID NO: 9)
94CY017.41 -----AGC-T-....    9060 (SEQ ID NO: 10)
94IN476.104 -----....----.-C-   8959 (SEQ ID NO: 11)
```

Fig. 13Z

```
GAG
93BR20.1      MGARASVLSGGKLDAWEKIRLRPGGKKKYRLKHLVWASRELERFALDPGLLETSEGCRKI    60
92NG083.2     V------------S----------R---K---I-------G----NRD----A---VQ-    60
90CF056.1     ---------------------------------------------N------P---LQ-    60
92RW009.6     ------I-R--------K-K----T-MM----------------N-D----P---KQ-    60
92NG003.1     -----------------------------M---------------N-D----T---QQ-    60
93BR029.4     ------I---E--K----------H-------I-----------VN-----------Q-    60
94CY032.3     ----------------R---------------------------N------A---QQL    60
96ZM651.8     ------I-R-----K----------R-MI----------------N----------KQ-    60
96ZM751.3     ------I-R-----E--R-------H-MM---I------------N----------KQ-    60
94CY017.41    ------I-----------------------------K-SIN------P----Q-       60
94IN476.104   ------I-R-----R----------H-MI----------------N-----D--KQ-    60

93BR20.1      IGQLQPSLQTGSEELKSLYNTIAVLYYVHQKVEVKDTKEALEKLEEEQNKGRQKTQQATA   120
92NG083.2     MK--- A- --T---R--F--V-T--C----I--------P-EV-KI-KNSQ-EI---AK   119
90CF056.1     -E-I--AIK-T------F-LV----C--R-ID--------D-I---I---SQ------A-  120
92RW009.6     MR----A----TD--R-----V-T--C---ID--------D-I------SQ------E-   120
92NG003.1     MR-------T--I---F--V-T--C----RI---------EV-KI-KNSQ-E--K-AM    120
93BR029.4     LE----A-K------R-----V-T--C---ID---------I-----XSKK-A----A-   120
94CY032.3     ME---ST-K------R------TT-WC---RID-Q------D-I--I-S-SK-----A-   120
96ZM651.8     MK----A----T--R----- V-T--C--EG---R------DRI------IQ--I--K-.  119
96ZM751.3     -Q----A---T-- R------V-T--C--E-IK-R------D-I------SQ-I-.K-.   118
94CY017.41    -R----A----T---------VV---W---R-D--------D-I---------H-A-    118
94IN476.104   -K--H-A-K--T---R--F--V-T--C--AGI--R------D-I------SQ--I---KE  120

93BR20.1      EKG....VSQNYPIVQNLQGQMVHQSLPRTLNAWVKVIEEKAFSPEVIPMFSALSEGAT    176
92NG083.2     NE-NSNP---------A----I--AI----------V-----------------        179
90CF056.1     D-EKDNK---------A------AI----------V----------------         180
92RW009.6     ADKGK..---------A------AI----------Q-----T-----              178
92NG003.1     G--NSSQ---------A---V--PI---------N--------T-----            180
93BR029.4     NT-NNSQ---------AI----------V-----------------               180
94CY032.3     AA-GSSN--------A--------I----------------                    180
96ZM651.8     QQAADGK--------- --K---------------T------                   179
96ZM751.3     .EATGGK----------AI--------------G-N-----T-----              177
94CY017.41    DT-NSS..---------A-------AI----------V------T-----           176
94IN476.104   AD-K...------------P---------------T------                  177

93BR20.1      PQDLNTMLNTVGGHQAAMQMLKDTINEEAAEWDRLHPTQAGPIPPGQIREPRGSDIAGTT  236
92NG083.2     ---------------------D--------I--Q----------S-----           239
90CF056.1     ----A---------------------V--VH--------M------               240
92RW009.6     ----------------------V--V----VA---------                   238
92NG003.1     ---------------S---------Q-------                           240
93BR029.4     ---------------E---------V--VH--------M------               240
94CY032.3     ----M---I------------D---T--VH--------M------               240
96ZM651.8     ----------------------------VH----A---M------               239
96ZM751.3     ----------------------------VH----A------                   237
94CY017.41    ----------------------V--VH---------M------                 236
94IN476.104   -S--------------------VH---N----M----------                 237

93BR20.1      STLQEQIQWMTGNPPVPVGEMYKRWIILGLNKIVRMYSPVGILDIRQGPKEPFRDYVDRF  296
92NG083.2     ------R---S---I----I----------------S-----                  299
90CF056.1     ------A-------AI---DI---------------S----K-----             300
92RW009.6     ------A---N---I----I----------------S----K-----             298
92NG003.1     ------T---S---I----I----------------S----K-----             300
93BR029.4     ----------S--------I---------------TS--G------              300
94CY032.3     ------G---S-------I----------T---IS-----                    300
96ZM651.8     ------A---S---I--DI-----------------S----K-----             299
96ZM751.3     G------A---N---I---DI---------------S----K-----             297
94CY017.41    -------G---SD-I----I----------------S-----                  296
94IN476.104   - ----A------I---DI---------------S-----                   297

93BR20.1      FKTLRAEQATQEVKGWMTDTLLVQNANPDCKTILKALGPGATLEEMMTACQGVGGPSHKA  356
92NG083.2     -----------------------------R-----                         359
90CF056.1     ----------D--N---E----------------R---Q--SI-----             360
92RW009.6     ---------S-D--N-------------------R-------S--------G---     358
92NG003.1     --------------N-------------------R---A----L-----           360
93BR029.4     Y-------TS-D--N---E-------- A -----------G---                360
94CY032.3     --C---------N---E----------S----T-----                      360
96ZM651.8     --------------N-----                                         359
96ZM751.3     ----------D--?--------------------R---------G---            356
94CY017.41    --------------N----------RS--R------S-----                  356
94IN476.104   ----------------------R------S---V-----                     357
```

Fig. 14A

```
93BR20.1      RVLAEAMSQATNTA...IMMQKSNFKGQRRIVKCFNCGKEGHIAKNCRAPRKKGCWKCGR    413
92NG083.2     ---------SGA-AAA----------P---I-------------L-R-------------K    419
90CF056.1     ---------V---N.TA-----G------KF--------------R----------------    419
92RW009.6     ---------VQQPN...-----RG--------I------------L-R-------------K    415
92NG003.1     ---------R--G-S.AA-----N----P--GI------------L-R-------------K    419
93BR029.4     ---------V--SG..T----RG--RN--KTI------------------------------K    418
94CY032.3     ---------S-A-.AA------K------TI--------------L-R-------------K    419
96ZM651.8     ---------TNSVN....-L--------NK-M--------------R---------------K    416
96ZM751.3     ---------VN--N...----------PK----------R-----R-----G---------K    413
94CY017.41    ---------HVQS-N.TN-----RG--R--K-.I-----------L-R-------------K    414
94IN476.104   ---------SHSN.....-----RG----PK--------------------R------Q      413

93BR20.1      EGHQMKDCTE.RQANFLGKIWPSNKGRPGNFIQNRP......EPSAPPAESFRFGEE.TT    465
92NG083.2     ------E----.-----------------L---T......--T-------G-----IA    471
90CF056.1     ----------------------S--------L-S--.....--T-------G-----M-    471
92RW009.6     ----------------------P-S-L.......--T-----N-GM---.IA         467
92NG003.1     -----------------------------L----......--T-------G-----IA    471
93BR029.4     -----------.-----------H-------L-S--......--T--------------V-- 471
94CY032.3     -----------.----------RM---S-------L----....--T-----CLERK--.-- 471
96ZM651.8     -----------.-----------H-------L----......--T-----------.--  467
96ZM751.3     -----------.----------Q-------L----EPTAPPA-T---*------E-.--   470
94CY017.41    -----------.-----------P-S-T........--T-----NL-M---.I-         466
94IN476.104   -----------.-----------H-------L----......--T---------K-..--  464

93BR20.1      PSPKQEQKDEGLYPPLASLKSLFGNDP...1    492 (SEQ ID NO: 172)
92NG083.2     ------P-EKE--..-T-------S--...1    497 (SEQ ID NO: 173)
90CF056.1     -------LKDKEP.-----R----S--LLQ1   500 (SEQ ID NO: 174)
92RW009.6     SPL------REP...I----------LSQ1   494 (SEQ ID NO: 175)
92NG003.1     --L---PREKESP.--T-----------...1  497 (SEQ ID NO: 176)
93BR029.4     --Q---PI-KEM-.-----R-------SSQ1   500 (SEQ ID NO: 177)
94CY032.3     S-L---PR-KE--...T-------S--LSQ1   500 (SEQ ID NO: 178)
96ZM651.8     -A----S--RE...A-T-------S--LSQ1   494 (SEQ ID NO: 179)
96ZM751.3     -A-R-----KE...--TA------S--LSQ1   497 (SEQ ID NO: 180)
94CY017.41    S-L---LETREP-N-AI----------LLQ1   496 (SEQ ID NO: 181)
94IN476.104   -A-----S--RE....--T-------S--LSQ1 491 (SEQ ID NO: 182)
```

Fig. 14B

```
POL
93BR020.1   FFRENLAFQQGEARKL.....HPEQARAVSPASRE......LQVRGGD.NP...IS.EAG     44
92NG083.2   ---------------.....S---D--N--T---......-RI-R--.S-...LP.---       44
90CF056.1   ---------R----F.....S----TN--N--T---......-R--R--.D-...L-.---     44
92RW009.6   ---------------F.....S--TG-N--T---......-WNG-R-.SL...S-.-T-        44
92NG003.1   ---------------EF.....SS-----N--TR--........-R--R--.S-...FP.---    44
93BR029.4   --------P--K--EF.....PS--T--N--T---..........---W-RGN-S...L..-T-   45
94CY032.3   -----V----R----FSSEQA.......--N--.RGM......-REER--N.....LLS---     44
96ZM651.8   --------P--K--EF.....PS-----N--T---.......---...--.-....R----      43
96ZM751.3   --------PE---GE-.....PS--T--N--T-SNSPTSRE----.--.--....CP---       49
94CY017.41  ---------R----F.....SS--N--N--T---.........-ENG-R-N.....LLP---     44
94IN476.104 --------P-----EF.....PSK----N--T---..........---Q-DN.....PRS---    43

93BR020.1   AE.RRGTVPSLSFPQITLWQRPLVTIRVGGQLKEALLDTGADDTVLEDVNLPGKWKPKMI       103
92NG083.2   -K.GE-AI.--N------------VKI----I--------------GI-----------       102
90CF056.1   -AEGQ--..-----------------VKIE---R--------------EI---------       102
92RW009.6   ---.-Q--...FN-----------VKI----R--------------EI-----------       100
92NG003.1   --.GK-IT..INL----------V-I----I----........QI-------------      102
93BR029.4   -D.-Q-D-..-FG-----------VKI----------------EI----R--------       103
94CY032.3   T-.GQ--I.-FN-----------KL---IR----------------EI-----------       102
96ZM651.8   V-.-Q-...-N--------------S-K----I----------G----EI---------       99
96ZM751.3   ---.-Q-...T-NC-----------S-K----I----------------EI--------       105
94CY017.41  TG.DQ--IQ-CN-----------VKIE----------------------FI--------       103
94IN476.104 V-.-Q-.T..-N-------------S-K----I----------------EIA---R---      99

93BR020.1   GGIGGFIKVKQYDSILIEICGHRAIGTVLVGPTPVNIIGRNMLTQIGCTLHFPISPIETV    163
92NG083.2   ---------R---Q-----G-KK-----------I------------N------------    162
90CF056.1   ---------R--EQVA----KK-----------------I---  ----N------------    162
92RW009.6   ---------Q------KK-----------S---------------N------------      160
92NG003.1   ---------Q-----E-KK----------I---------------N------------     162
93BR029.4   ---------R---Q-P-----RK-T--------L----------N------------      163
94CY032.3   ---------R---Q-P------KK---------------L----N------------      162
96ZM651.8   --------E-R---Q-PM---KK-----------------L----N------------     159
96ZM751.3   ---------R---Q------KK-----------------L----N------------      165
94CY017.41  ---------R---Q-A----K-----------------V-L----N------------     163
94IN476.104 ---------R---Q------KK---------------D---L----N------------    159

93BR020.1   PVKLKPGMDGPKVKQWPLTEEKIKALTEICMEMEKEGKISKIGPENPYNTPVFAIKKKDS    223
92NG083.2   -----------R-------------KD-----------------------I---------   222
90CF056.1   -------------------------T------------R-------S--I---------    222
92RW009.6   --A------------------------R---T----------------------------  220
92NG003.1   -------I------------------TD---------------------I----------   222
93BR029.4   -----------R-------------T---------------------------------    223
94CY032.3   -------------------------TD---------------------I----------    222
96ZM651.8   ------------------------A--E--------T-----------------------  219
96ZM751.3   -----------R------------A--E--------T-----------------------  225
94CY017.41  -------------------------K---------------------------------    223
94IN476.104 -------------------------K------T--------------------R---    219

93BR020.1   TKWRKLVDFRELNKRTQDFWEVQLGIPHPAGLKKKKSVTVLDVGDAYFSVPLDKDFRKYT    283
92NG083.2   ---------------------------R-------------------------------    282
90CF056.1   -----------------------------S-----------------------E-----   282
92RW009.6   --------------------------------------------------ES-----     280
92NG003.1   ---------------------------R---------------I---EN-----        282
93BR029.4   -----------------------------------------------------------   283
94CY032.3   -------------------------------------------------PE-----      282
96ZM651.8   --------------------------------------------------ES-----     279
96ZM751.3   --------------------------------------------------EG-----     285
94CY017.41  -----------------------------A-----------------HE-----        283
94IN476.104 -------------------------------------------------EG-G---      279

93BR020.1   ASTIPSTNNETPGVRYQYNVLPQGWKGSPAIFQYSMTKILDPFRAKNPDIVIYQYMDDLY    343
92NG083.2   -F----I------I----------------S------E-S-T---EM-----------    342
90CF056.1   -F----I------I----------------S------A--EQ--EM-----------     342
92RW009.6   -F----I------I--------------N-----E----Q-QE-----------        340
92NG003.1   -F----I------I----------------S------E---TE--E-----------     342
93BR029.4   -F-----------L----------------S------E---KQ-------------      343
94CY032.3   -F-----------I----------------C------E--F---E-----------      342
96ZM651.8   -F----I------I----------------S------E----Q-------------      339
96ZM751.3   -F----I------I--------------S-S--I----E--TQ--E-----------    345
94CY017.41  -F-----------I----------------S------E--S--TELI----------    343
94IN476.104 -F----I------I----------------S------E--R--K-----------     339
```

Fig. 15A

```
93BR020.1    VGSDLEIGQHRTKIEELREHLLKWGLTTPDKKHQKEPPFLWMGYELHPDKWTVQPIQLPD    403
92NG083.2    -----------A------------------------------------------------E    402
90CF056.1    -----------A------A------F------------------------TVK--E       402
92RW009.6    -----------A-------------F----------------------------------E   400
92NG003.1    ------T----A------N---R--F----------------------------------N   402
93BR029.4    ----------------Q---R--F--------------------------------V--E   403
94CY032.3    -----------A---------R--F---------------------------------PAE  402
96ZM651.8    -----------A------------F-----------------------------------AE  399
96ZM751.3    -----------A------R--F--------------------------------K--E     405
94CY017.41   -------S---V------A------FY---------------------------K--E     403
94IN476.104  --------H--A------A------F----------------------------K--E     399

93BR020.1    KDSWTVNDIQKLVGKLNWASQIYPGIKVQLCKLLRGAKALTDIVPLTTEAELELAENRE    463
92NG083.2    -ED----------------------H--R------------------A---M-------   462
90CF056.1    ------------------------N----------------I---K-------------   462
92RW009.6    ---------------------V--R--------T----------E--------------   460
92NG003.1    -E---------------------------------------------E-----------   462
93BR029.4    -------------------A----R---------T----EV----A-------------   463
94CY032.3    -----------------------------------------------------------   462
96ZM651.8    ----------------A-----R-----------------E-----------K-------  459
96ZM751.3    -E-----------------?----A----R-------------E----------S--    464
94CY017.41   -----------------------A-----------------T--K-----E----      463
94IN476.104  -----------------------R-----------------E-----------------   459

93BR020.1    ILKEPVHGAYYDPSKDLIAEIQKQGQGQWTYQIYQEPFKNLKTGKYAKMRSAHTNDVKQL   523
92NG083.2    --------V-H----E----V----PD----------Y----------RG---------   522
90CF056.1    --R--I--V--------R----------------------------T------I---    522
92RW009.6    --------V-----------HD-----------------R-T-----------------   520
92NG003.1    --------V------E----L----CD----------Y----------RG---------   522
93BR029.4    --------V---------------------------Y----------R--G--------   523
94CY032.3    -------------------------H----------RT---------R--         522
96ZM651.8    --------V-----------HD--------------------T----_-----       519
96ZM751.3    --------V-----------HD-----V----------------T--------       524
94CY017.41   ---T----V---------D---------------------R--T----I---       523
94IN476.104  --------V-----------HD---------------------T---------      519

93BR020.1    TEAVQKISLESIVIWGKT.PKFRLPILKETWDTWWTEYWQATWIPEWEFVNTPPLVKLWY   582
92NG083.2    --V----AT-G------I.---K---R----EV--------A-----------------   581
90CF056.1    --------T--------I.-------Q----E--------------------H------   581
92RW009.6    ------AM--------,.-------Q----E----D---------------         579
92NG003.1    -------AT-------V.---K---R----EV--------D------------------   581
93BR029.4    -----TT--------I.---K---Q----EA--I------------------        582
94CY032.3    ------AM-C-------,.-------Q--------------------------        581
96ZM651.8    -------A----I----,.-------Q----E----D--------------L-------   578
96ZM751.3    ------AM--------I.-------Q----E----D-----------------       583
94CY017.41   ------TM-----------,---K---Q----E---A----------------       582
94IN476.104   ---AI-----?--,-------Q----E----D---------D---------        577

93BR020.1    QLETEPIVGAETFYVDGASNRETKKGKAGYVTDRGRQKAVSLTETTNQKAELQAIQLALQ   642
92NG083.2    -------P----Y-----A-----L----H---K-K--IIT----------H-------   641
90CF056.1    -------A----Y-I---A-----L-------K--V--------T-----Y----     641
92RW009.6    ---K---L--------A----I--------------I----------T-----       639
92NG003.1    R------P----Y-----A-K---L----------K--IITIQ------T--H------   641
93BR029.4    ---K--------------A-----L--------------V-P--D-----T-----H---- 642
94CY032.3    ----D--A----------A-----Q-----------V--S------T-----Y----   641
96ZM651.8    ---K--------------A-----L--------I-----I-T--------T-----Y----  638
96ZM751.3    ---K---A----Y-----A-----I--------------I-T--------T----------  643
94CY017.41   ---K---A----------A-----L--------------I----------T--H--Y----  642
94IN476.104  ---K--------------A-----V--------------I----------T------   637

93BR020.1    DSGSEVNIVTDSQYALGIIQAQPDKSESELVNQIIEQLIKKEKVYLSWVPAHKGIGGNEQ   702
92NG083.2    --RP-----------------R G----------------E------------------   701
90CF056.1    ---L------------------------E------------------------------   701
92RW009.6    ----------------S----A--------------R--T-------------------   699
92NG003.1    -----------------R------------------------------------------   701
93BR029.4    ---L----------------L-I-----------I--A----------------------  702
94CY032.3    ----------------I-------R---D--------R-D--------------------  701
96ZM651.8    ----------------H--------------R----------------------------  698
96ZM751.3    --------------------------------R---------------------------  703
94CY017.41   ---L------------------ER----I-------K--E--R-----------------  702
94IN476.104  ---T-----------------------------N--R-----------------------  697
```

Fig. 15B

```
93BR020.1    VDKLVSAGIRKVLFLDGIDKAQEEHEKYHNNWRAMASDFNIPAVVAKEIVASCDKCQLKG      762
92NG083.2    ------S-------------------R--S----------L-P----------------      761
90CF056.1    ------S-V-----------------R--------V-----L-PI---------------     761
92RW009.6    ------S---R---------------R--S-----------L-PI---------------     759
92NG003.1    ------S-----------------D-R--S-----------L-PI---------------     761
93BR029.4    ------S----------------------------------P------------------     762
94CY032.3    ------N----------------------------------L-S-----------N-----    761
96ZM651.8    ------K----------------------------E--L-P-------------Q--       758
96ZM751.3    ------S-----------------------S-------E--L-PI---------------     763
94CY017.41   ------S-------------------R--S------H---L-P-----------------     762
94IN476.104  --R---S-----------------D-----S-----NE--L-PI----------------     757

93BR020.1    EAMHGQVDCSPGIWQLDCTHLEGKIILVAVHVASGYLEAEVIPAETGQETAYFLLKLAGR      822
92NG083.2    ---------------------------I---------------------I-------       821
90CF056.1    ----------------------QV---------I----------K----------S-        821
92RW009.6    ------------------------A----I-------------------I------        819
92NG003.1    ------------------V-I---------I--------------------------       821
93BR029.4    ------------------V--------G--I--------------------------       822
94CY032.3    ------------------V-M---------I--------------------I------      821
96ZM651.8    --T---------------------------I------------------YI------       818
96ZM751.3    --I-----------------V---------I------T-----------L-I------      823
94CY017.41   --------------------V---------I------T----D----I------         822
94IN476.104  --------R--------------------I-------------------YI------       817

93BR020.1    WPVKTIHTDNGTNFTSATVKAACWWAGIQQEFGIPYNPQSQGVVESMNKELKKIIGQIRD      882
92NG083.2    ----V------P--I--A---------N-T------------------------VG-       881
90CF056.1    ----V------S-----A---------D--------------------------V--       881
92RW009.6    ----V------S----N---------------I---------------------V--       879
92NG003.1    ----V------S-----AM------N----------------------------V--       881
93BR029.4    -----------S----T----------K----I---------------------V--       882
94CY032.3    ----M--A---P-----A--------D-N-------------------------V--       881
96ZM651.8    ----V------S-----A---------K--------------------------V--       878
96ZM751.3    ----VV-----S-----A---------H--------------------------V--       883
94CY017.41   ----V------P--I---------------------------------------V--       882
94IN476.104  ----V------S-----A------------------------------------V-E       877

93BR020.1    QAEHLKTAVQMAVFIHNFKRKGGIGGYSAGERTIDIIATDIQTRELQKQIIKIQNFRVYY      942
92NG083.2    ---------------------------I-----S----K-----------------        941
90CF056.1    ---------------------------I----------K-----SN--K-----          941
92RW009.6    -----R---------------------I----------K------T---------        939
92NG003.1    ---------------------------I-----S----K-----------------        941
93BR029.4    --------T------------------IV---------K------T---------         942
94CY032.3    ---------------------------I-----S----K------T---------         941
96ZM651.8    ----------------R----------I----------K------N--K-----          938
96ZM751.3    ---------------------------I----------------------------        943
94CY017.41   ---------------------------I----------K---R--T---------         942
94IN476.104  ----------------------------------------K---N--T---------       937

93BR020.1    RDSRDPVWKGPAKLLWKGEGAVVIQDNSEIKVVPRRKAKIIRDYGKQMAGDDCVAGRQDE     1002
92NG083.2    ------I--------------------N------------LK--------G--------     1001
90CF056.1    ------I----------------------E------------------S----           1001
92RW009.6    ------I---------------D------------------------------           999
92NG003.1    ------I---------------D----------V---K---------G--------        1001
93BR029.4    ------L---------------D--------V-------------G--------           1002
94CY032.3    ----E-I---------------D-------------------------N--------       1001
96ZM651.8    ------I---------------D-------------------------A--------       998
96ZM751.3    ------I---------------D---I--------------------T-S------        1003
94CY017.41   ------I---------------D-----------------------------------      1002
94IN476.104  ------I---------------D-------------------------A--------       997

93BR020.1    D....1  1003  (SEQ ID NO: 183)
92NG083.2    -....1  1002  (SEQ ID NO: 184)
90CF056.1    -....1  1002  (SEQ ID NO: 185)
92RW009.6    -....1  1000  (SEQ ID NO: 186)
92NG003.1    -....1  1002  (SEQ ID NO: 187)
93BR029.4    -....1  1003  (SEQ ID NO: 188)
94CY032.3    -....1  1002  (SEQ ID NO: 189)
96ZM651.8    -....1   999  (SEQ ID NO: 190)
96ZM751.3    -....1  1004  (SEQ ID NO: 191)
94CY017.41   -....1  1003  (SEQ ID NO: 192)
94IN476.104  -QNME1  1002  (SEQ ID NO: 193)
```

Fig. 15C

VIF

```
93BR020.1    MENRWQVMIVWQVDRMRINTWKSLVKYHMHISKKAKGWFYRHHFESRHPKISSEVHIPLE       60
92NG083.2    --------------V-----------R--N----H--YV-----------Y-----RV--------R    60
90CF056.1    ------------------------------------R--R-----------T--R---------G    60
92RW009.6    ----------------K-R--N----H--YA-RR---------Y---------------G        60
92NG003.1    ------V----------R--N-------YK-----D------Y------V---------G        60
93BR029.4    ------V------------------V-----R----------RV--------                60
94CY032.3    -A--------------K-R--N----H--YV----- ------Y------V--------G        59
96ZM651.8    ------AL---------R--N----H--Y--R--N-------Y-----RV--------G         60
96ZM751.3    -------L--------K-R--N----H--YV-RTGR------Y---------------G         60
94CY017.41   ----------------R--N----H--Y--R-----V-K--Y--N-R---------G           60
94IN476.104  -------L---------R--N----H--YV-RR--S-------Y------V-A------G        60

93BR020.1    TAELVITTYWGLLPGEREWHLGQGVSIEWRQGRYRTQIDPGLADQLIHIYYFDCFSESAI         120
92NG083.2    D-T--VR-----HA--KD-Q--H--------K--S-----NT--H---L----------         120
90CF056.1    E-R---------NT----------------LK--S--VE---------MH---------         120
92RW009.6    E-R---K-----QT---D----H-------LR--K--V-----G----MH-----AD---       120
92NG003.1    E-R--VR-----HT---D-----------K-R--S-----D-------LH--N------V       120
93BR029.4    E-K---------HT---D------------------------------------------       120
94CY032.3    E-R--VR-----Q---QD----H-------LR--S--V--D-------MH----------       119
96ZM651.8    D-K---K-----QT---D----H-------LR--S--V----------MH-----AD---       120
96ZM751.3    D-K---K-----H---------H-------LR--S--V----------MH--N--AD---       120
94CY017.41   E-RIIVR-----HI--KD----H-------N--H-----D---H---L-----------        120
94IN476.104  D-R---K-----QT---D----H-------L---S--VE---------MH-----AD---       120

93BR020.1    RKAILGHKISPRCNYQAGHNKVGSLQYLALTALIAPKKTKPPLPSVQKLVEDRWNKPQKT        180
92NG083.2    ------EIV----E-P---------SK--VT-TRKR------G--A-------               180
90CF056.1    ------RVVR-----P---KQ--T--------V-----I------R---------            180
92RW009.6    -------IV----D-------------------K---I--------S-----K------        180
92NG003.1    ------EVVR---E--T---Q---------K--VT-TQ--------K--T-----E----       180
93BR029.4    ------R------D-------------------------R------K--T---------       180
94CY032.3    ------RV----E-----------------A---S----------K-------------        179
96ZM651.8    ------IVI---D-------------------K---R-------R--------NS---         180
96ZM751.3    ---L---IVI---D------------------K---I-------R--------------        180
94CY017.41   ----I-EIV----E----------------K-VV-STR--------R-------------       180
94IN476.104  ------IVIS---D------------------K---R-------K---------N----        180

93BR020.1    RGHRESHTMNGH1       192  (SEQ ID NO: 194)
92NG083.2    -D---NP------1      192  (SEQ ID NO: 195)
90CF056.1    ----G--------1      192  (SEQ ID NO: 196)
92RW009.6    --R-GN-------1      192  (SEQ ID NO: 197)
92NG003.1    ----G--ST----1      192  (SEQ ID NO: 198)
93BR029.4    KD--G--------1      192  (SEQ ID NO: 199)
94CY032.3    --R--NQI-----1      191  (SEQ ID NO: 200)
96ZM651.8    K-R-GN--VS---1      192  (SEQ ID NO: 201)
96ZM751.3    K-R-GN-I-----1      192  (SEQ ID NO: 202)
94CY017.41   K---G-------C1      192  (SEQ ID NO: 203)
94IN476.104  -D--GN-------1      192  (SEQ ID NO: 204)
```

Fig. 16

VPR

```
93BR020.1    MEQAPEDQGPQREPYNEWTLDLLEELKNEAVRHFPRPWLHSLGQHIYNTYGDTWEGVEAI    60
92NG083.2    --------------------E----------------------G---Y-----------    60
90CF056.1    ---------------H-----E----I------------V---Q--------V----L    60
92RW009.6    --------------------E---A--Q-----------D---Y--E------R-----    60
92NG003.1    --R----------F-----E------H----X....---G-------------------V--    56
93BR029.4    --------------------E------S--------L----------E------A-----    60
94CY032.3    --------------N-----E-----------------G--------------------    60
96ZM651.8    ---F----------S----EI-----Q----------------E------T-----    60
96ZM751.3    ------N----------A-E------Q--------T---N------Q------T----L    60
94CY017.41   -------------------M-E------Q--------H---G---Y-------------V-    60
94IN476.104  ---S-------;--------E------Q--------  ------Y--E-----A-T----L    59

93BR020.1    IRILQQLLFIHFRIGCRHSRIGITRQRRVRNGTSRS1       96  (SEQ ID NO: 205)
92NG083.2    ----------------Q-------P-----D-PG-P1       96  (SEQ ID NO: 206)
90CF056.1    --T-------------Q-------------P---1         96  (SEQ ID NO: 207)
92RW009.6    ----------------LQ---A---A---1              96  (SEQ ID NO: 208)
92NG003.1    ----------------Q------IPG--G---AG--1       92  (SEQ ID NO: 209)
93BR029.4    ----------------Q------N----A---A---1       96  (SEQ ID NO: 210)
94CY032.3    ----------------Q-------P---RGR-W-Q.1       95  (SEQ ID NO: 211)
96ZM651.8    ----------------Q-----MV----A---A---1       96  (SEQ ID NO: 212)
96ZM751.3    ----------------Q------M----A---A---1       96  (SEQ ID NO: 213)
94CY017.41   --Y-------V-----Q------I-R----D-A--P1       96  (SEQ ID NO: 214)
94IN476.104  --T-------------Q------LQR--A---A---1       95  (SEQ ID NO: 215)
```

Fig. 17

TAT

```
93BR020.1    MELVDPNLDPWNHPGSQPTTPCTRCYCKWCCFHCYWCFTTKGLGISYGRKKRRQRPRTPQ    60
92NG083.2    -DP---K-E------------NK----V--W--QV--LN-------------P-RG---    60
90CF056.1    -DP---K-E--------Q-A-NN----K--Y--QM--LK-------------S--H---A    60
92RW009.6    --P---K-E---------K-A-NN----H-SY--LV--QA--------------RNA-P    60
92NG003.1    ------S-E----------A-NK----I--W--QL--LN-------------R-RG---    60
93BR029.4    --P---R-E--K----R-Q-A-NS----K------QV-------------------H---    60
94CY032.3    --P---D-E---------D-NK-F--K--W--QV--LK-------------KH-RGSL-    60
96ZM651.8    --P---SIE---------K-A-NK----R-SY--LV--Q----------------RS--P    60
96ZM751.3    --P---R-E---------K---NK----H-SY--LV--Q----------------RSA-P    60
94CY017.41   --P---K-E---------K-A--K----R-Y--QL--IN-------------P-RKPSP    60
94IN476.104  --P-----E---------K-A-NT----H-SY--LV--Q----------------RSA-P    60

93BR020.1    SSQIHQDFVPKQPISQA.RGNPTGPKESKKEVESKAKTDP...1    99  (SEQ ID NO: 216)
92NG083.2    G-KD--NP-----LPIT.S-----SEKP----A--TE---LD1     101 (SEQ ID NO: 217)
90CF056.1    -L-D--NSIS---L-RT.H-D------Q----A--TE----.1     99  (SEQ ID NO: 218)
92RW009.6    --ED--NPIS---L--T.--D---SE----K----TEA--FD1     101 (SEQ ID NO: 219)
92NG003.1    -H-D--NP-----LPTT.-----------------TE--QCA1     101 (SEQ ID NO: 220)
93BR029.4    ---L---P-----A---.Q--------------Q------..1    99  (SEQ ID NO: 221)
94CY032.3    G-KG--NLI----L--QPN-DS---E-Q--K-A--TEA--FA1     102 (SEQ ID NO: 222)
96ZM651.8    --ED---PIS---L-RT.Q-----QE----K----T-R--CD1     101 (SEQ ID NO: 223)
96ZM751.3    --ED--NPIS---L--P.---Q--SE----K----TE--QFD1     101 (SEQ ID NO: 224)
94CY017.41   -NKD--NPI---SLP--.QRV----E-P--------E--RFD1     101 (SEQ ID NO: 225)
94IN476.104  --ED--NLIS---LP-T.------SE----K----T---FD1     101 (SEQ ID NO: 226)
```

Fig. 18

REV

```
93BR020.1   MAGRSGDSDQELLKAVRYIKILYQSNPYPKP.EGTRQARRNRRRRWRARQRQIREISDRI    59
92NG083.2   -------P-E---R---I--T---------S-.A------K-------------HS--E--    59
90CF056.1   ------A--T---QVCKI---------C-E-.T---------------------E--      59
92RW009.6        ET--Q--KI------------.-----------------------HS--E--      59
92NG003.1   -------A-E---RVT-I----------P-.-------K-------------SAL-E--    59
93BR029.4   --------T------S---------L---K---------------------E--         59
94CF032.3   ------NI-ED-F--A-A---------NNPT----------------K--HSL-E--      60
96ZM651.8   ---------AA--L-A-T----------E-.K------K-----------E--A--E--    59
96ZM751.3   -------N-EA--Q---I----------N-.-------K-------------NS--E--    59
94CY017.41  T----D-P-ES--Q-I-T-------------RGS.---Q-------------DS--E-V    59
94IN476     ---------AA--Q---I----------R-.------Q--------------HS--E--    59

93BR020.1   LSSCLGRPAEPVPLQLPPLERLHINCSEDCGQGAEE........GVGSSQISGESHTVLGS   112
92NG083.2   --A----------F------G-SLD--K-G-TSGTQQPQGTET---RP-VLV-PPV----   119
90CF056.1   -T-------P---T----------TL--------TSG-K........-E--P--L--S-I--T 112
92RW009.6   --T------T----F-----I---T-D----G-TSGTQQSQGTTE---NP...........   107
92NG003.1   --T----------------I----SLD-----SRTPETQQSPGTET---GP---V--PV----  119
93BR029.4   --------E------------------T--....----P-T----RA--E-          112
94CF032.3   -ATY------------K-TL-------TSGDK...........----P-V-V-LPA---T   113
96ZM651.8   --T-----T---------I-----GD--SG-ASETQQSQGTTE----P............   107
96ZM751.3   --T----P----F----------D--GTT...........E--N-.......          96
94CY017.41  -RT-----T---------------D-----TSGTLQSQGTET---R--E-V--SVI---   119
94IN476     --T----ST---------I-----G---SG-TSGTQQSQGTTE----P............   107

93BR020.1   GTKE1       116  (SEQ ID NO: 227)
92NG083.2   ----1       123  (SEQ ID NO: 228)
90CF056.1   ----1       116  (SEQ ID NO: 229)
92RW009.6   ....1       107  (SEQ ID NO: 230)
92NG003.1   ----1       123  (SEQ ID NO: 231)
93BR029.4   ----1       116  (SEQ ID NO: 232)
94CF032.3   -A--1       117  (SEQ ID NO: 233)
96ZM651.8   ....1       107  (SEQ ID NO: 234)
96ZM751.3   ....1        96  (SEQ ID NO: 235)
94CY017.41  --E-1       123  (SEQ ID NO: 236)
94IN476     ....1       107  (SEQ ID NO: 237)
```

Fig. 19

VPU

```
93BR020.1    MSNL..LAIGIAA...LIVALIITIVVWT.IAYIEYKKLVRQRKINRLYKRISERAEDSG    54
92NG083.2    -QA-...EISX........----F-AATI--S.-VF---R-IRK-K--EK-LD--R------    51
90CF056.1    -YI-...G.L--G-...-V-TF--AVI---.-V----------K--D--IE--G-------    53
92RW009.6    -TS-...EIYA-V-....-------V------.L-G------LK----D--I-K-R-----    54
92NG003.1    -QS-...EIAA--G...-V--A-AA-----.-.....X-IKK-E--D--LD--R-------    49
93BR029.4    --Y-...-V--L--...---A----A-----.------RE--------------R-------    54
94CY032.3    -LFW..EIWA-VG...-V-----V------.LVF------R---R-DS--N--R-------    54
96ZM651.8    -LD-LARVNYRVGVGA-----L-A-----.------R--L-----DW-I---R--------    59
96ZM751.3    -L--EARVDYRIGVGA--A----A-A--I.-V-----R--S-----D--I---R-------    59
94CY017.41   -LP-..VILA-VG...------LA------.-VF-----IKK----DW-I-----------    54
94IN476.104  -V--LERVDYRLGVGA------LA-.IVWT---L--R--L--------IE--R--V----    59

93BR020.1    NESEGDAEELAALGEVGPFIPGDINNL1    81  (SEQ ID NO: 238)
92NG083.2    ------T----T-M-M-D-D-WVG---1    78  (SEQ ID NO: 239)
90CF056.1    ---D--T---SK-M-M-HLNL-YVAD-1    80  (SEQ ID NO: 240)
92RW009.6    ---D--ID--SK-VG--NYDL--V---1    81  (SEQ ID NO: 241)
92NG003.1    ------T----T-VDMVD-D-WVGD--1    76  (SEQ ID NO: 242)
93BR029.4    --------------M--------D--1    81  (SEQ ID NO: 243)
94CY032.3    ---D------ST-VGM-N-D-WVGD--1    81  (SEQ ID NO: 244)
96ZM651.8    ------T----TMVDM-HLRLL-V-D-1    86  (SEQ ID NO: 245)
96ZM751.3    ------N----TMVDM-HLRLL-AIDV1    86  (SEQ ID NO: 246)
94CY017.41   ---D--T---S--V-R-HLDF--V--V1    81  (SEQ ID NO: 247)
94IN476.104  ------T---ST-VDM-NLRLL-A-D-1    86  (SEQ ID NO: 248)
```

Fig. 20

```
ENV
93BR20.1      MRVRGMQRNWQHLGKWGLLFLGTLIICNAAENLWVTVYYGVPVWKEATTTLFCASDAKSY      60
92NG083.2     ---K-T-------W---T-I--LV---S-SD------------ED-D-P----------      60
90CF056.1     ...MET---YPS-WR--T-I--M-L--S--Q----------------K---------A-      57
92RW009.6     ---M-TLM-Y-N-WG--TMI--M-T--S--N-----------D-E-----------A-      60
92NG003.1     ---K-T--------WT-WT-I--LV---S-SN----------ED-D-P--------A-      60
93BR029.4     ---------------------I-----.             -----------------A-      59
94CY032.3     ---M-----YP--WE--T-I--LV---S-SN---------RD-E-------E--A-      60
96ZM651.8     ----EIL----RWWT--I-GFWM-M---VWG----------------K---------      60
96ZM751.3     ---K-IM----QWWI--I-GFWM-LM---MGK---------------K---------A-      60
94CY017.41    ---M-T---Y---WRG-I-I--M--M K-TD.----------D-D-I---------A-      59
94IN476.104   -----IL--C--WWI--I-GFWM-M-Y-VVG----------------K---------A-      60

93BR20.1      EKEAHNVWATHACVPTDPNPQEVVLENVTERFNMWENNMVEQMHTDIISLWDQSLKPCVK     120
92NG083.2     SS-K----------------IAI-----N----K------QE------EE-------     120
90CF056.1     -T-K-----------M-M--S------------------------------------     117
92RW009.6     DP-K-----------I--D---IH------E----K----------------------     120
92NG003.1     ST-R---------------IT        T----K--------E-------E------     120
93BR029.4     ----------------------------N-D--K------------------------     119
94CY032.3     ---V--I-----------A-I----N----K-D------E------NEG----A-     120
96ZM651.8     ---V----------------I--G----N----K-D--D---E---------------     120
96ZM751.3     -T-V-------------- ---M-------K         D---E------------     120
94CY017.41    DT-V---.-----------IN------N----K------QE--------------     119
94IN476.104   ---V--I----------------MD-V----N----K-D--D---E-V---------     120

93BR20.1      LTPLCVTLDCR........NIATNGTNDTIAIND.TLKEDPEA..IQNCSFNTTTEIRD     168
92NG083.2     -----I--N-T........-VNSANHTEANN-VENK-.E...K----KI---RGG     164
90CF056.1     --------N-T........-VR-N-SNSTS.SMEAG.GE..LT-----V--VL--     160
92RW009.6     --------E-N........NITNVNNTVNITDDMKGE..-K-----M---L--     163
92NG003.1     --------N-T....NVNCNSNV-STG-SAGTNATCNIE-A.NN..LK-----I------     173
93BR029.4     ------R-S........NAT-NSTQND----E-G-.........M--V--     162
94CY032.3     --S----FT-I........NAT-TNSTNG-VIKEG.....-K----DI------     161
96ZM651.8     --------N-TEVNV.......TR-VN-SVVNNTTNVNNSMNGD..MK-----I---LK-     171
96ZM751.3     --------N-TANIT............-NANIT-NANITNYNNETDMR-----I---L--     168
94CY017.41    ------I N-SNANT............S-HSNSSS-QSPIN-E...K---Y----IL--     164
94IN476.104   --------N-SKVTN...................--..ATYNNTDD...K-----A------     158

93BR20.1      KQLKVHALFYKLDIVQI........NKDDN...RTY....RLINCDASTITQACPKVSWD     213
92NG083.2     -KKEEY-------V-P-........SNGNK...TS-------H-NV--K-------NF-     209
90CF056.1     --Q-------R--V-P-........DNNSTQY...........-NT-V------FE     204
92RW009.6     -KQR-YS---R-------........-SNS-NS.SHNQ..Y-----NT-A--------FE     212
92NG003.1     -KKTEY----R--V-P-........DGNN-VS.NN-........-NV---K-------F-     220
93BR029.4     ------R-----P-........SN-NSSN.DNSSREY-----NT--L---------     213
94CY032.3     -KK-EY----RI---P-NARVPINGSNRN.....NSTEEYM----N----K-------FE     216
96ZM651.8     -KKN-Y---------SL........-ET-DSETGNSSKYY-----NT-AL--------F-     223
96ZM751.3     -RRQ-D--------P-........-ENS......S..EY-----NT-A--------TF-     212
94CY017.41    -TQ--YS---R--V--LDE......SENK..NTSGSNTLY-----NT----------TFE     216
94IN476.104   -KR-EY----R----PLNE........-NS.....SSNYSEYI----NT----------F-     208

93BR20.1      PIPIHYCAPAGYAILKCNEKNFTGTGSCKNVSTVQCTHGIKPVVSTQLLLNGSLAEGE.I     272
92NG083.2     ------------F-----RD-EYN---P-------------------------ED.-     268
90CF056.1     ------------F------N-T-N---L-T-----------R-----------EQ.-     263
92RW009.6     ----N------F-----KD-K-N---P-------------------------E-.-     271
92NG003.1     -L---------F-----RG-------Q-----S----------------------.     279
93BR029.4     -----------F-----D-K-N---P-R-------------------------KD.-     272
94CY032.3     -----------F-----------L-P-T---S-R-------------------TE-.V     275
96ZM651.8     -----------------N-T-N---P-H-------------------------EG.-     282
96ZM751.3     -----------------N-T-N---P-N-------------------------E-.-     271
94CY017.41    -----------F-----KDPR-N----S------------A--------------GK-     276
94IN476.104   -----------F-----KDET-N---P--E-----------------------T--K-.-     267

93BR20.1      VIRSQNISDNAKTIIVHLNESVQINCTRP.NNNTRKRISLGPGRVFYTTGEIIGDIRKAH     331
92NG083.2     R---E-FT--T-V---Q--N-IE---I---.------S-PI---QA--A--D------Q--     327
90CF056.1     I--TK-----T-N---Q-KTP-N-T----.------TS-H-----A--A--D------Q--     322
92RW009.6     I---E--TN-------Q---T-----S--.------SVHI---QA--A--DV-----Q-Y     330
92NG003.1     ----E-LT----V---Q--KTIG-----.------S-RI---QA--A--------     332
93BR029.4     I-----------Q--V--P-----.------S-PI----A--------Q--     331
94CY032.3     ----K--T--T-N---Q-AKA-K------G--T.--SVHI---LTW-A---------Q--     334
96ZM651.8     I---E-LTN-V--------R-IE-V--.-----QS-RI---QT--A--D------Q--     341
96ZM751.3     I---K-MT----I----------E-V---.------SVRI---QT--A--D----N--Q-Y     330
94CY017.41    M---E--TN---N---QFTKP-L-T-I---.------S-RF---QA---.N-------Q--     334
94IN476.104   IT---E--T----------IK-V----.------S-RI---QA--A--NG------Q--     326
```

Fig. 21A

```
93BR20.1      CNVSGTQWRNTLAKVKAKLGSYFPNAT.IKFNSSSGGDLEITRHNFNCMGEFFYCNTDEL    390
92NG083.2     ----RIK--EM-KN-T-Q-RKIYN-KN.-T----A-------T-S---R--------SG-    386
90CF056.1     --I-R-D-NK--HQ-VTQ--IHLN-R-.-S-KPN----M-VRT-S---R--------SG-    381
92RW009.6     -T-N--K-NR--Q--AE- SH--E-I-T-I-KN---------T-S---G--------SG-    390
92NG003.1     .....QE-QEM-Q--Q-Q-EQV-NKSI..T----A-------T-S---R--------SG-    385
93BR029.4     ------K-NE -E--R---KPH----.-----------------M-S---R--------SG-    390
94CY032.3     --I--ND-ND--KVISEE-KRL---K-.---APPV-------T-S---K--------TP-    393
96ZM651.8     --I-R-N-TK--RE-RN--REII---KN.-T-KP--------T-S---R--------SG-    400
96ZM751.3     --I-EGK-N---QR-GE--RK----K-.-S-AP---------T-S---R--------SK-    389
94CY017.41    --INK-L-ND--Q--AEQ-REK--KK-.-I-TN-----P---TLS---A--------TG-    393
94IN476.104   --I-ESN-TK--QE-GK--AKH---K-.-S---Q--------VT-S---G--------SR-    385

93BR20.1      FN..............DTKFNDTGFNGTITLPCRIKQIVNMWQEVGRAMYANPIAGNI     434
92NG083.2     --...............NNISNIN-E------K-----R---K--Q----L-----L      428
90CF056.1     --SSW........EMHTNYTS---KG-EN-------------R-------P--Q---      432
92RW009.6     --STW.........SKRNGTWQSN-TELN----------I---RT-Q----P--Q-V-     440
92NG003.1     --...............ESGG...NDT------K-----R---R--Q----P----D-     425
93BR029.4     --................DTV...D----------------------------A------     429
94CY032.3     --STH........MQNGTNITSTDST-S----Q--L--F-R-----Q----S----S-     444
96ZM651.8     -SINY..TE......NNT.......DGTP------R--I----------P--E--      444
96ZM751.3     --GTF..NGT.....NTS.....NDRS-S----Q------T----G--Q----P--K---    437
94CY017.41    --GTWWNNGTW...NGP....YTPNNT--S-I---------I---R-------P----I-    446
94IN476.104   --GTY..NGTDMPTYNGT......NSSSDI-M-----R-FI-I--K-------P--E---    437

93BR20.1      TCNSNITGLLLTRDGG..LNSTN....ETFRPGGGNMKDNWRSELYKYKVVEIEPLGVAP    488
92NG083.2     V-K------I------..N-NDS..TE--------D-R-----------T-K-KS-----    484
90CF056.1     M-V---------I-E-.NA-AE...NY------D-R-----------K-----I--       487
92RW009.6     S-V-----------..N-N-T...T--   --D-R-----------K-----         495
92NG003.1     --R-------------..V-N-G...N--------D-R-----------I-K-K---I--    480
93BR029.4     --S--------------.Q-NQT...E-----------------------              484
94CY032.3     N-S-D---II-------......TNNT-I-----D-R-----------K---I----       497
96ZM651.8     A-K-D------V----STND----.NNT-I---A--D-R---------------K --I--   503
96ZM751.3     --K---------------T.NDTET...P--------D-----------K------       493
94CY017.41    K-T-----II-------..N-G-....N--------D-R-----------KL------     500
94IN476.104   --E---------V----DTNS-.....T-I------D-R-----------K---I--      492

93BR20.1      TKAKRQVVKRERRAVGLGALFLGFLGAAGSTMGAASITLTVQARQLLSGIVQQQSNLLRA    548
92NG083.2     -R-R-R--E--K------V---------------A-V-----------------        544
90CF056.1     --TR-R--E--K----M--S----------------------------             547
92RW009.6     -R---R--E--K-------V-I-------------------------------         555
92NG003.1     ---R-R--E-GK------V---------G-------V-----------------        540
93BR029.4     ----------K----M------------------A-------------N-----        544
94CY032.3     N--R-R--Q--K ---I--M--------------M--------------------        556
96ZM651.8     -E---R--E--K----I--V---------------A----V--------------       563
96ZM751.3     --R-R--E--K----I-V---------------------V-----------------     553
94CY017.41    -R---R--E--K-------V------------L--------  --------Q-           560
94IN476.104   -E---R--E--K----I--V-------V-------M------------------K-      552

93BR20.1      IEAQQHLLQLTVWGIKQLQARVLAVERYLKDQQLLGLWGCSGKLICTTNVPWNSSWSNKS    608
92NG083.2     --------------------S----I-----------I---------T------        604
90CF056.1     -Q-R--M---------------------R------I-----------------T        607
92RW009.6     -------K----------L----R-----------I-----------------T        615
92NG003.1     -------------------------------I---------T------              600
93BR029.4     --------------------I-------------------------D-----------    604
94CY032.3     --------R--------L-S--------I--------------------             616
96ZM651.8     ---------------T----I---------------A----I------              623
96ZM751.3     ------M-------------I---------------A-----------              613
94CY017.41    --------K---------------------------I---------A-T----T------    620
94IN476.104   ------M----------T----I-------------I----V--P-A----------     612

93BR20.1      LEEIWGNMTWMEWEKEVSNYSKEIYRLIEDSQNQQEKNEQELLALDKWASLWNWFDITQW    668
92NG083.2     YN---D----L---R-IH--TQH--S---E--------D-------------SN-       664
90CF056.1     QS---D-------D-QI---TE-----L-V--T------D----------T----SH-    667
92RW009.6     QQ---D----QQ-D--IG--TQI--S---E--------D-----------N------SN-   675
92NG003.1     Y----D----IQ--R-----TQQ--S---E--------D----------------K-     660
93BR029.4     Q-K--------------I----N----E-------------------------SK-      664
94CY032.3     YND--D----LQ-D--IN--TQI--G-L-E--------D---------------S--K-    676
96ZM651.8     KTD--D-----Q-DR-I---TNT----L---S---Q--KD-----S-NN--------K-    683
96ZM751.3     ER---D-----Q-DR-IN--TET----L-V------N--RD-----S KN-----N--N-    672
94CY017.41    QD---D----LQ-D--I---TNI----L-E--------D--------D--S--N-SH-    680
94IN476.104   KDD--N-----Q-D--I---TNT----L-E--I---Q-GKD-----S-QN-----S--K-   672
```

Fig. 21B

```
93BR20.1    LWYIKIFIMIVGGLIGLRIVFTVLSIVNRVRKGYSPLSFQTHIPSPRE.PDRPEGIEEGG    727
92NG083.2   ----R---------------A---------Q---------LTHHQ--.---LGKT----    723
90CF056.1   -----------------I-A---------Q---------LV-N--G.------T----    726
92RW009.6   -----------------I-A---------Q---------L--N--G.---LG----E-    734
92NG003.1   ----------------A---------Q---------LTHHQ--.-----R-----    719
93BR029.4   ----------------A----------------L--RF-----.-----------    723
94CY032.3   -----------I-A---------Q------L--L--TTQRGL---C-T--E-    736
96ZM651.8   -----------I-A---------Q------L--N---.----GR---E-    742
96ZM751.3   -----------I---------I-A---------Q------L--L--T---.---LGR---E-    731
94CY017.41  ----R---------------AIITV-----Q----V---IPT---EG.----R-T----    739
94IN476.104 --------I----------I-A---------Q------L--LT-D---.---LR----E-    731

93BR20.1    GEQGKDRSVRLVTGFLALAWDDLRNLCLFSYRHLRDFILIAARIVDRGLK.......RGW    780
92NG083.2   ---DR---T---S-----------S------HR---LV-----T-ELLGRSSLKGLRL--    783
90CF056.1   ---DR--------N---PVV-----S-S-----L--LL--VV-T-ELLGR........-R    779
92RW009.6   ---DRG--I---S-----------S------HR---LL-----T-ELLGRSSLRGLQ---    794
92NG003.1   ---DR--------S-----------HR---LV-----TAELLRRSSLQGLRL--    779
93BR029.4   --P---------N----V-----------------------------.---    776
94CY032.3   ---DRS--I---N---P-I-------------NLL--V--T-ELLGIR........--    789
96ZM651.8   ---D-E------S-----------S------HR------VT--A-ELLRRSSLKGLQ---    802
96ZM751.3   ---DR---I---N-----V---------HR-------GLQ...........---    780
94CY017.41  ----R---I---N--F--------S------HR---C------T-ELLGHCSLKGLRL--    799
94IN476.104 ---D----I---N-----------S-----CHR------V---A-ELLGRSSLRGLQ---    791

93BR20.1    EALKYLGNLTQYWGQELKNSAISLLNATAIAVAEWTDRVIEALQRAGRAILNIPRRIRQG    840
92NG083.2   -G----W--LL---R--------N--DTI---T-NG------VA---Y-----V-T-----    843
90CF056.1   ------W--L-------------D---T-------G--GI-VIV---W----H--------    839
92RW009.6   -T----V----L---R---N--DT---V---G---I--LI--IS---Y---S-----    854
92NG003.1   -G----W--LL---R--------N-IDTI---N-------VA-G-C--------    839
93BR029.4   ----L----AL--S-------------T---V---G-----------V--V-------    836
94CY032.3   ------W-FLL----------N-F-T------G---I---V---C---C---------    849
96ZM651.8   -------S-V----L---K------DTI------G---I--LI-GIC---R-V-------    862
96ZM751.3   -T-----S-V----L---K------DTI------G---I--LT-IC---R-V-------    840
94CY017.41  -G--N-W--LL---R--------FDTI-V----------IG---F----------    859
94IN476.104 -------S-V----L---K------DTI--TI--G---I--FT--IC---R---------    851

93BR20.1    LERALL1     846  (SEQ ID NO: 249)
92NG083.2   ------1     849  (SEQ ID NO: 250)
90CF056.1   F--S--1     845  (SEQ ID NO: 251)
92RW009.6   F-A--Q1     860  (SEQ ID NO: 252)
92NG003.1   ------1     845  (SEQ ID NO: 253)
93BR029.4   ------1     842  (SEQ ID NO: 254)
94CY032.3   ------1     855  (SEQ ID NO: 255)
96ZM651.8   F-T---1     868  (SEQ ID NO: 256)
96ZM751.3   F-A--Q1     846  (SEQ ID NO: 257)
94CY017.41  ------1     865  (SEQ ID NO: 258)
94IN476.104 F-A---1     857  (SEQ ID NO: 259)
```

Fig. 21C

NEF

```
93BR020.1     MGGKWSKSSIVGWPAIRERMRRTPPTPP.AAE............GVGAVSQDLERRGAIT    47
92NG083.2     ---------------Q----I-Q--V...---..............------A-H----      44
90CF056.1     --------RMG--ST--------AE-....V--..............------R--D----V-   44
92RW009.6     --S----C-P-----V---L-Q-E-...---................------A----DKY--L-  44
92NG003.1     I--------------V---I-Q-.....P-...............----AP---A-H----    43
93BR029.4     --S----------------L-Q---...---................--------------    44
94CY032.3     ---------------E-------ARA....EP-RMRRAQAEPAAA---------DKH----    56
96ZM651.8     ---------------V---I---E.....P-AE...............----A----DKY--L-   44
96ZM751.3     -------R------KV---IA--D.....P-AE...............----A----DKY--L-   44
94CY017.41    -------R--P---------------AQRTEAV.....S.PAAP---------ATH--V-     54
94IN476.104   --S-M---R-----EV--------E.....P-AE...............----A----AKH--L-  44

93BR020.1     SSNTRANNPDLAWLEAQEED.EVGFPVRPQVPLRPMTYKGAVDLSHFLKEKGGLEGLIYS   106
92NG083.2     ----AT----C---------SD-----------------A-F---F--------D-----   104
90CF056.1     IN--AST-R-A-------DGE------------------F--------------D-----   104
92RW009.6     ----PS--A-C---A----EN------------------A-----F--------D-----   104
92NG003.1     ----AQT---C------Q-NS-------Q----------A-F---F--------D-----   103
93BR029.4     ----G---------------E.-----------------L--------------------   103
94CY032.3     IN--A-T---KT--------EE-----------------F---L----------D-----   116
96ZM651.8     ----STT-AAC---------EE.---------------A-----F---------D-----   103
96ZM751.3     ----ST--A-C---------EG-----------------S-F---F--------D----C   104
94CY017.41    ----A-T---C--V------ES-----------------F---F---F------D-----   114
94IN476.104   T---PS--AAG---Q----EE------------------F--AF----------D-----   104

93BR020.1     KRRQEILDLWVYHTQGYFPDWQNYTPGPGIRYPLTMGWCFKLVPVDPEEVEKANEGENNC   166
92NG083.2     ----D--------N---F-------------T-L---F--------M--A-I-E--K---IS  164
90CF056.1     -Q--D--------N---------------E-F--F---------N-Q---Q-------S   164
92RW009.6     -K--D--------N-----------------V-----F---Y-------R---E-----D--  164
92NG003.1     -K--D--------N-----------------T-F---FR------M--A-I-E--K---S   163
93BR029.4     -K-------------------------------T-----------L--------------   163
94CY032.3     -K-----------F----D-------E-F--CF----------Q---E-T----T-   176
96ZM651.8     -K-----------F---------------V---F----------G---E-------   163
96ZM751.3     -K-----------------------------F---Y-------R---E-----D--   164
94CY017.41    QK--D---M-----------------------F---------E-S---E-TQ----S   174
94IN476.104   -K-H---------N-----------------F---Y-------SV--E--K-----   164

93BR020.1     LLHPMSQHGMEDEDKEVLKWEFDSRLALRHIARERHPEYYQD.1   208   (SEQ ID NO: 260)
92NG083.2     ----IC---------R---V-R-N-S--R--L---L-----K-C1   207   (SEQ ID NO: 261)
90CF056.1     ------L----DGR---M-K------T-L--VK-----.K-C1   206   (SEQ ID NO: 262)
92RW009.6     ----L---------R-----K--H--H--M---L-----K-C1   207   (SEQ ID NO: 263)
92NG003.1     ----IC---L--A-R---V-R---S--R------Q-----K-C1   206   (SEQ ID NO: 264)
93BR029.4     -------------R-I-Q-R------FH-M---L-----K-C1   206   (SEQ ID NO: 265)
94CY032.3     ----I--------ER----K------YK-V---L---F-K-C1   219   (SEQ ID NO: 266)
96ZM651.8     -------Q--D-DHR-----K---H--HK-M---L-----K-C1   206   (SEQ ID NO: 267)
96ZM751.3     ----I----I-----R--R-K---S--R--M---L-----K-C1   207   (SEQ ID NO: 268)
94CY017.41    ----IC--VD-PER---R----RS--R--R---L-----K-C1   217   (SEQ ID NO: 269)
94IN476.104   ----------D---G------Q---S--R------L-----K-C1   207   (SEQ ID NO: 270)
```

REFERENCE CLONES AND SEQUENCES FOR NON-SUBTYPE B ISOLATES OF HUMAN IMMUNODEFICIENCY VIRUS TYPE 1

CROSS-REFERENCE TO RELATED APPLICATIONS

This is a divisional application of non-provisional U.S. Ser. No. 09/184,418, filed Nov. 2, 1998 now U.S. Pat. No. 6,492,110.

FEDERAL FUNDING LEGEND

This work was funded by grants RO1 AI25291; and NO1 AI35170 from the National Institutes of Health. Therefore, the government may have certain rights in the invention.

BACKGROUND

1. Field of the Invention

The present invention is in the field of virology. The invention relates to the nucleotide sequences of the genomes of 11 molecular clones for non-subtype B isolates of human immunodeficiency virus type 1 (HIV-1), and nucleic acids derived therefrom. This invention also relates to peptides encoded by and/or derived from the nucleic acid sequences of these molecular clones, and host cells containing these nucleic acid sequences and peptides. The invention also relates to diagnostic methods, kits and immunogens which employ the nucleic acids, peptides and/or host cells of the invention.

2. Description of the Related Art

A critical question facing current AIDS vaccine development efforts is to what extent HIV-1 genetic variation has to be considered in the design of candidate vaccines (11,21, 42,72). Phylogenetic analyses of globally circulating viral strains have identified two distinct groups of HIV-1, a major M group and an O group (33,45,61,62). Within the M group, ten sequence subtypes (A–J) have been proposed (29,30,45, 72). Sequence variation among viruses belonging to these different lineages is extensive, with envelope amino acid sequence variation ranging from 24% between different subtypes to 47% between the two different groups. Given this extent of diversity, the question has been raised whether immunogens based on a single virus strain can be expected to elicit immune responses effective against a broad spectrum of viruses, or whether vaccine preparations should include mixtures of genetically divergent antigens and/or be tailored toward locally circulating strains (11, 21, 42, 72). This is of particular concern in developing countries where multiple subtypes of HIV-1 are known to co-circulate and where subtype B viruses, which have been the source for most current candidate vaccine preparations (10, 21), are rare or nonexistent (5, 24, 40, 72).

Although the extent of global HIV-1 variation is well defined, little is known about the biological consequences of this genetic diversity and its impact on cellular and humoral immune responses in the infected host. In particular, it remains unknown whether subtype specific differences in virus biology exist that need to be considered for vaccine design. Only a comprehensive analysis of genetically defined representatives of the various groups and subtypes will address the question of whether certain variants differ in fundamental viral properties and whether such differences will need to be incorporated into vaccine strategies. Obviously, such studies require well-characterized reference reagents, in particular full length and replication competent molecular clones that can be used for functional and biological studies.

Full-length reference sequences representing the various subtypes are also urgently needed for phylogenetic comparisons. Until about 1994, it was generally thought that individuals do not become infected with multiple distinct HIV-1 strains, and so the possibility that recombination between divergent viruses could contribute to the evolution of HIV-1 was not widely considered. However, recent analyses of subgenomic (23,52,54,58) as well as full-length HIV-1 sequences (7,18,53,60) identified a surprising number of HIV-1 strains which clustered in different subtypes in different parts of their genome. All of these originated from geographic regions where multiple subtypes co-circulated and are the results of co-infections with highly divergent viruses (52,60,62).

Recombinant viruses can be detected because their phylogenetic affinities vary depending on the region of genome analyzed. A useful initial approach is to examine the extent of sequence divergence/similarity between a new sequence and a bank of reference sequences of different subtypes, for example as a diversity plot (18), or using the RIP program (75); if the extent of relative similarity to different subtypes varies along the sequence, this may indicate that the sequence is a recombinant. However, fuller investigation must involve a phylogenetic approach, comparing trees derived by analyses of different regions of the genome, and assessing the confidence of phylogenetic clustering by a statistical approach such as the bootstrap. A thorough analysis would involve taking a window of sequence of a certain size, and moving this window along the genome in steps of a defined size, generating perhaps hundreds of trees for visual examination in the process. There are at least two short cuts. One is to analyze only a few windows, defining selected regions according to the output of the diversity analysis. Another is to not examine the entire phylogenetic tree of all subtypes, but to focus on one particular phylogenetic question. Thus, if the initial analyses suggest that a sequence may be a recombinant between two particular subtypes, it is possible to ask simply what is the bootstrap value for the clustering of the new sequence with one or another particular subtype, and plot these values as a function of position along the genome; this is the basis of the "bootscanning" approach (57). Once the subtypes putatively involved in the recombination event have been identified, and the crossover points have been approximately localized, more precisely defined breakpoints can be determined, and their statistical significance assessed, using informative site analysis (19, 52, 53).

Detailed phylogenetic characterization revealed that most of the recombinant viruses have a complex genome structure with multiple points of crossover (7,18,53,60). Some recombinants, like the "subtype E" viruses, which are in fact A/E recombinants (7,18), have a wide-spread geographic dissemination and are responsible for much of the Asian HIV-1 epidemic (69,70). In other areas, recombinants appear to be generated with increasing frequencies as many randomly chosen isolates exhibit evidence of mosaicism (4,8, 31,66,71).

Since recombination provides the opportunity for evolutionary leaps with genetic consequences that are far greater than the steady accumulation of individual mutations, the impact of recombination on viral properties must be monitored. Full-length non-recombinant reference sequences for all major HIV-1 groups and subtypes are thus needed to map and characterize the extent of inter-subtype recombination.

Non-subtype B viruses cause the vast majority of new HIV-1 infections worldwide. Although their geographic dissemination is carefully monitored, their immunogenic and biological properties remain largely unknown, in part because well-characterized virological reference reagents are lacking. In particular, full length clones and sequences are rare, since subtype classification is frequently based on small PCR-derived viral fragments. There are currently only five full length, non-recombinant molecular clones available for viruses other than subtype B (45), and these represent only three of the proposed (group M) subtypes (A, C and D). Moreover, only three clones (all derived from subtype D viruses) are replication competent and thus useful for studies requiring functional gene products (45,48,65). Given the unknown impact of genetic variation on correlates of immune protection, subtype specific reagents are critically needed for phylogenetic, immunological and biological studies.

SUMMARY OF INVENTION

The present invention pertains to the isolation and characterization of the genomic sequences of 11 molecular clones for non-subtype B HIV-1 isolates of human immunodeficiency virus type 1 (HIV-1), and nucleic acids derived therefrom. Of these 11 molecular clones, 94IN476.104, 96ZM651.8, and 96ZM751.3 are non-mosaic reference clones of HIV-1 subtype C; 93BR020.1 is a reference clone of HIV-1 subtype F; 90CF056.1 is a reference clone of HIV-1 subtype H; 92RW009.6 is a double recombinant of HIV-1 subtypes A/C; 92NG083.2 and 92NG003.1 are double recombinants of HIV-1 subtypes A/G; 93BR029.4 is a double recombinant of HIV-1 subtypes B/F; 94CY017.41 is a double recombinant of HIV-1 subtype A and a new, as yet undefined, subtype; and 94CY032.3 is a triple recombinant of HIV-1 subtypes A/G/I.

In particular, the present invention relates to nucleic acids comprising the genomic sequences of one or more of these 11 clones for non-subtype B HIV-1 isolates, as well as nucleic acids comprising the complementary (or antisense) sequence of one or more of the genomic sequences of these 11 clones, and nucleic acids derived therefrom.

The invention also relates to vectors comprising the nucleic acid genomic sequence of one or more of these 11 clones, as well as nucleic acids comprising the complementary (or antisense) sequence of one or more of the genomic sequences of these clones, and nucleic acids derived therefrom.

The invention also relates to cultured host cells comprising the nucleic acid genomic sequences of one or more of these 11 clones for non-subtype B HIV-1 isolates, as well as nucleic acids comprising the complementary (or antisense) sequence of one or more of the genomic sequences of these clones, and nucleic acids derived therefrom.

The invention also relates to host cells containing vectors comprising the genomic sequences of one or more of these 11 clones for non-subtype B HIV-1 isolates, as well as nucleic acids comprising the complementary (or antisense) sequence of one or more of the genomic sequences of these clones, and nucleic acids derived therefrom.

The invention also relates to synthetic or recombinant polypeptides encoded by or derived from the nucleic acid sequences of one or more of the genomes of these 11 clones for non-subtype B HIV-1 isolates, and fragments thereof.

The invention also relates to methods for producing the polypeptides of the invention in culture using one or more of these 11 clones for non-subtype B HIV-1 viruses or nucleic acids derived therefrom, including recombinant methods for producing the polypeptides of the invention.

The invention further relates to methods of using the polypeptides of the invention as immunogens to stimulate an immune response in a mammal, such as the production of antibodies, or the generation of cytotoxic or helper T-lymphocytes.

The invention also relates to methods of using the polypeptides of the invention to detect antibodies which immunologically react with non-subtype B HIV-1 viruses in a mammal or in a biological sample.

The invention also relates to kits for the detection of antibodies specific for non-subtype B HIV-1 viruses in a biological sample where said kit contains at least one polypeptide encoded by or derived from the nucleic acid sequences of the invention.

The invention also relates to antibodies, which immunologically react with the virions of one or more of these 11 viruses and/or their encoded polypeptides.

The invention also relates to methods of detecting virions of non-subtype B HIV-1 viruses and/or their encoded polypeptides, or fragments thereof, using antibodies of the invention.

The invention also relates to kits for detecting the virions of non-subtype B HIV-1 viruses and/or their encoded polypeptides, wherein the kit comprises at least one antibody of the invention.

The invention also relates to a method for detecting the presence of non-subtype B HIV-1 viruses in a mammal or a biological sample, said method comprising analyzing the DNA or RNA of a mammal or a sample for the presence of the RNAs, cDNAs or genomic DNAs which will hybridize to a nucleic acid derived from one or more of these 11 non-subtype B HIV-1 molecular clones. Usually, when a completely complementary probe is used, high stringency conditions are desirable in order to prevent false positives. However, conditions of high stringency should only be used if the probes are complementary to target regions which lack heterogeneity. The stringency of hybridization is determined by a number of factors during hybridization and during the washing procedure, including temperature, ionic strength, length of time, and concentration of formamide, if any. The nucleic acid sequences used in probes should be unique to HIV, i.e., the nucleic acid sequences should be absent from individuals not infected with HIV.

The invention also provides diagnostic kits for the detection of non-subtype B HIV-1 viruses in a mammal using the nucleic acids of the invention. In one embodiment, the kit comprises nucleic acids having sequences useful as hybridization probes in determining the presence or absence of the RNAs, cDNAs or genomic DNAs of non-subtype B HIV-1 viruses. In another embodiment, the kit comprises nucleic acids having sequences useful as primers for reverse-transcription polymerase chain reaction (RT-PCR) analysis of RNA for the presence of HIV-1 viruses in a biological sample.

The invention further relates to isolated and substantially purified nucleic acids, polypeptides and/or antibodies of the invention.

The invention further relates to compositions comprising one or more of the nucleic acids, polypeptides and/or antibodies of the invention.

The invention also relates to computer-generated alignments of the nucleic acid sequences of the viral genomes clones of the 11 clones of this invention, as well as alignments of the encoded amino acid sequences. These sequence alignments serve to highlight regions of homology and non-homology between different sequences and hence, can be used in preparing diagnostic reagents as described herein.

BRIEF DESCRIPTION OF THE DRAWINGS

So that the matter in which the above-recited features, advantages and objects of the invention, as well as others that will become clear, are attained and can be understood in detail, more particular descriptions of the invention briefly summarized above may be had by reference to certain embodiments thereof that are illustrated in the appended drawings. These drawings form a part of the specification. It is to be noted, however, that the appended drawings illustrate preferred embodiments of the invention and therefore are not to be considered limiting in their scope.

(FIG. 4A) Bootstrap plots depicting the relationship of 92RW009.6 to representatives of subtype A and C, respectively. Trees were constructed from the multiple genome alignment and the magnitude of the bootstrap value supporting the clustering of 92RW009.6 with U455 and 92UG037.1 (subtype A), or C2220 and 92BR025.8 (subtype C), respectively, was plotted for a window of 500 bp moved in increments of 10 bp along the alignment. Regions of subtype A or C origin are identified by very high bootstrap values (>90%). Points of cross-over of the two curves indicate recombination breakpoints. The beginning of gag, pol, vif, vpr, env and nef open reading frames are shown. The y-axis indicates the percent bootstrap replicates, which support the clustering of 92RW009.6 with representatives of the respective subtypes. (FIG. B) Bootstrap plots depicting the relationship of 93BR029.4 to representatives of subtype B and F, respectively. Analyses are as in FIG. 4A, except that bootstrap values supporting the clustering of 93BR029.4 with SF2, OYI, MN, LAI and RF (subtype B), or 93BR020.1 (subtype F), respectively, were plotted. Subtype D viruses were excluded from this analysis because of their known close relationship with subtype B viruses.

FIGS. 7A–7C. Subtype specific genome features. (FIG. 7A) Alignment of deduced Tat (region encoded by second exon) amino acid sequences. Consensus sequences were generated for available representatives of all major subtypes (question marks indicate sites at which fewer than 50% of the viruses contain the same amino acid residue). Dashes denote sequence identity with the consensus sequence, while dots represent gaps introduced to optimize alignments. A vertical box highlights a premature Tat protein truncation (asterisk) which is present in 11 of 15 subtype D, and 4 of 52 subtype B viruses (frequencies are listed in the column on the right). (FIG. 7B) Alignment of deduced Rev (region encoded by the second exon) protein sequences. (FIG. 7C) Alignment of deduced Vpu protein sequences.

FIGS. 13A–13Z. Nucleotide sequence alignment of the 11 near full-length HIV-1 sequences included in this patent application. Sequences were aligned using CLUSTAL W and adjusted manually using the sequence editor MASE. Dots indicate gaps introduced to optimize the alignment. The beginning and end of all open reading frames are indicated by arrows above or below the alignment. The homologies between the sequences of nucleotides in the eleven independent clones are indicated by dashes. Sequences of nucleotides present uniquely in the various clones (as compared to the corresponding sequences of the other ten clones) are indicated by letters, i.e., the sequences themselves.

FIGS. 14A–14B. Amino acid sequence alignments of the Gag polypeptides encoded by the 11 near full-length HIV-1 sequences included in this patent application. The homologies between the sequences of amino acids in the various polypeptides encoded by the eleven independent clones are indicated by dashes. Sequences of amino acids present uniquely in the various polypeptides (as compared to the corresponding polypeptides of the other ten clones) are indicated by letters, i.e., the sequences themselves.

FIGS. 15A–15C. Amino acid sequence alignments of the Pol polypeptides encoded by the 11 near full-length HIV-1 sequences included in this patent application. The homologies between the sequences of amino acids in the various polypeptides encoded by the eleven independent clones are indicated by dashes. Sequences of amino acids present uniquely in the various polypeptides (as compared to the corresponding polypeptides of the other ten clones) are indicated by letters, i.e., the sequences themselves.

FIG. 16. Amino acid sequence alignments of the Vif polypeptides encoded by the 11 near full-length HIV-1 sequences included in this patent application. The homologies between the sequences of amino acids in the various polypeptides encoded by the eleven independent clones are indicated by dashes. Sequences of amino acids present uniquely in the various polypeptides (as compared to the corresponding polypeptides of the other ten clones) are indicated by letters, i.e., the sequences themselves.

FIG. 17. Amino acid sequence alignments of the Vpr polypeptides encoded by the 11 near full-length HIV-1 sequences included in this patent application. The homologies between the sequences of amino acids in the various polypeptides encoded by the eleven independent clones are indicated by dashes. Sequences of amino acids present uniquely in the various polypeptides (as compared to the corresponding polypeptides of the other ten clones) are indicated by letters, i.e., the sequences themselves.

FIG. 18. Amino acid sequence alignments of the Tat polypeptides encoded by the 11 near full-length HIV-1 sequences included in this patent application. The homologies between the sequences of amino acids in the various polypeptides encoded by the eleven independent clones are indicated by dashes. Sequences of amino acids present uniquely in the various polypeptides (as compared to the corresponding polypeptides of the other ten clones) are indicated by letters, i.e., the sequences themselves.

FIG. 19. Amino acid sequence alignments of the Rev polypeptides encoded by the 11 near full-length HIV-1 sequences included in this patent application. The homologies between the sequences of amino acids in the various polypeptides encoded by the eleven independent clones are indicated by dashes. Sequences of amino acids present uniquely in the various polypeptides (as compared to the corresponding polypeptides of the other ten clones) are indicated by letters, i.e., the sequences themselves.

FIG. 20. Amino acid sequence alignments of the Vpu polypeptides encoded by the 11 near full-length HIV-1 sequences included in this patent application. The homologies between the sequences of amino acids in the various polypeptides encoded by the eleven independent clones are indicated by dashes. Sequences of amino acids present uniquely in the various polypeptides (as compared to the corresponding polypeptides of the other ten clones) are indicated by letters, i.e., the sequences themselves.

FIGS. 21A–21C. Amino acid sequence alignments of the Env polypeptides encoded by the 11 near full-length HIV-1 sequences included in this patent application. The homologies between the sequences of amino acids in the various polypeptides encoded by the eleven independent clones are indicated by dashes. Sequences of amino acids present uniquely in the various polypeptides (as compared to the corresponding polypeptides of the other ten clones) are indicated by letters, i.e., the sequences themselves.

FIG. 22. Amino acid sequence alignments of the Nef polypeptides encoded by the 11 near full-length HIV-1 sequences included in this patent application. The homologies between the sequences of amino acids in the various polypeptides encoded by the eleven independent clones are indicated by dashes. Sequences of amino acids present uniquely in the various polypeptides (as compared to the corresponding polypeptides of the other ten clones) are indicated by letters, i.e., the sequences themselves.

DETAILED DESCRIPTION OF THE INVENTION

Figures 1A, 1B:
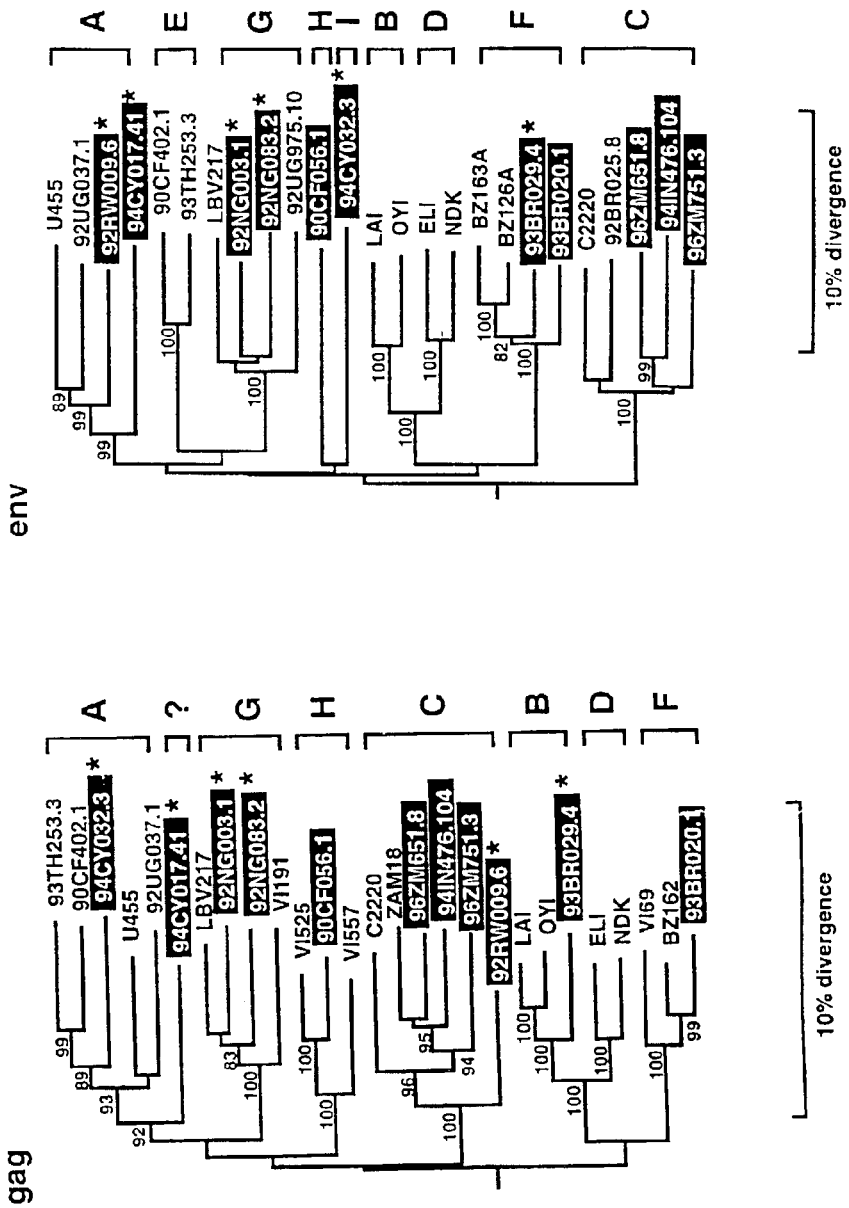
FIGS. 1A–1B. Phylogenetic relationships of the 11 viral genomes described in this patent application (highlighted) to representatives of all major HIV-1 (group M) subtypes in gag (FIG. 1A) and env (FIG. 1B) regions. Trees were constructed from full-length gag and env nucleotide sequences using the neighbor joining method (see text for details of methodology). Horizontal branch lengths are drawn to scale; vertical separation is for clarity only. Values at the nodes indicate the percent bootstraps in which the cluster to the right was supported (bootstrap values of 75% and higher are shown). Asterisks denote hybrid genomes as determined by additional analyses. Brackets at the right represent the major sequence subtypes of HIV-1 group M. Trees were rooted by using SIVcpzGAB as an outgroup.

The present invention relates to the determination of the nucleic acid sequences of the complete or near complete genomes of 11 non-subtype B HIV-1 viruses isolated from primary isolates collected at major epicenters of the global AIDS pandemic. The nucleotide sequences of these 11 viruses are shown in FIGS. 13A–13Z (SEQ ID NOS: 1 to 11).

The phrase "derived from" is used throughout the specification and claims with respect to nucleic acids to describe nucleic acid sequences which correspond to a region of the designated nucleotide sequence. Preferably, the sequence of the region from which the nucleic acid is derived is, or is complementary to, a sequence which is unique to the genome of any one of the 11 clones of this invention. However, more preferably, the sequence of the region from which the nucleic acid is derived is, or is complementary to, a sequence which is unique to the viruses in the subtype corresponding to the subtype of any one of the 11 clones of this invention, and whose uniqueness was unknown prior to the disclosure of the clones of this invention. For example, sequences in the Cyprus clone 94CY032.3 which map to the I region are unique wherever they are not identical to known prior art sequences. Whether or not a sequence is unique to the genome of one of the molecular clones or a subtype can be determined by techniques known to those of skill in the art. For example, the sequence can be compared to sequences in databanks, e.g., GenBank, to determine whether it is present in the uninfected host or other organisms. The sequence can also be compared to the known sequences of other viral agents, including other retroviruses. The correspondence or non-correspondence of the derived sequence to other sequences can also be determined by hybridization under the appropriate stringency conditions. Hybridization techniques for determining the complementarity of nucleic acid sequences are well known in the art. In addition, mismatches of duplex polynucleotides formed by hybridization can be determined by known techniques, including for example, digestion with a nuclease such as S1 that specifically digests single-stranded areas in duplex polynucleotides.

Regions of the viral genome from which nucleic acid sequences may be derived include, but are not limited to, regions encoding specific epitopes as well as non-transcribed and non-translated sequences. Preferably, the epitope is unique to HIV viruses in the subtype corresponding to the subtype of the corresponding region of a polypeptide encoded by any one of the 11 clones of this invention, and whose uniqueness was unknown prior to the disclosure of the clones of this invention The uniqueness of the epitope may be determined by its immunological reactivity with HIV viruses of the subtype and lack of immunological reactivity with other HIV viruses of the other subtypes. Methods for determining immunological reactivity are known in the art, e.g., radioimmunoassay and ELISA and other assays mentioned herein. The uniqueness of an epitope can also be determined by computer searches of known databases, e.g., for the polynucleotide sequences which encode the eptiope, and by amino acid sequence comparisons with other known proteins.

The derived nucleic acid is not necessarily physically derived from the nucleotide sequence shown, but may be generated in any manner, including for example, chemical synthesis or DNA replication or reverse transcription or transcription, which are based on the information provided by the sequence of bases in the region(s) from which the nucleic acid is derived. The derived nucleic acid is comprised of at least 6–12 bases, more preferably at least 15–19 bases, more preferably at least 30 bases. The derived nucleic acid may also be larger, e.g., at least 100 bases in length, depending on the desired use of the nucleic acid. In addition, regions or combinations of regions corresponding to that of the designated sequence may be modified in ways known in the art to be consistent with an intended use. The derived nucleic acid may be a polynucleotide or polynucleotide analog.

The term "recombinant nucleotide" or "recombinant nucleic acid" as used herein intends a nucleic acid of genomic, cDNA, semisynthetic, or synthetic origin which, by virtue of its origin or manipulation: (1) is not associated with all or a portion of the nucleic acid with which it is associated in nature; and/or (2) is linked to a nucleic acid other than that to which it is linked in nature.

The term "polynucleotide" as used herein refers to a polymeric form of nucleotides of any length, either ribonucleotides or deoxyribonucleotides. This term refers only to the primary structure of the molecule. Thus, this term includes double- and single-stranded DNA, as well as double- and single-stranded RNA. It also includes modified, for example, by methylation and/or by capping, and unmodified forms of the polynucleotide.

The present invention relates to nucleic acids having the genomic sequence of any one of the 11 molecular clones for non-subtype HIV-1 isolates of this invention as shown in FIG. 13 (SEQ ID NOS: 1 to 11), as well as fragments (or partial sequences) thereof. The invention also relates to nucleic acids having complementary (or antisense) sequences to the sequences shown in FIGS. 13A–13Z (SEQ ID NOS: 1 to 11), as well as fragments (or partial sequences) thereof. Partial sequences may be obtained by various methods, including restriction digestion of nucleic acids with sequences shown in FIGS. 13A–13Z (SEQ ID NOS: 1 to 11), PCR amplification, and direct synthesis. Partial sequences may be all or part of the LTR and/or other untranslated regions of the genomes of one or more of the 11 viral clones of this invention, and/or all or part of the genes encoding the Gag, Pol, Vif, Vpr, Env, Tat, Rev, Nef and Vpu proteins and/or complementary (or antisense) sequences thereof. Nucleic acids of the invention also include cDNA, mRNA, and other nucleic acids derived from the genomic sequences of one or more of these 11 HIV-1 clones. Sequences of the genes encoding Gag, Pol, Vif, Vpr, Env, Tat, Rev, Nef and Vpu are identified in FIGS. 13A–13Z.

Genomic sequences of seven of the 11 clones of the invention have been made publicly available. The GenBank Accession numbers are as follows:

| Clone | Accession No. | Sequence ID No. |
|---|---|---|
| 92R W009.6 | U88823 | 4 |
| 92NG003.1 | U88825 | 5 |
| 92NG083.2 | U88826 | 2 |
| 93BR020.1 | AF005494 | 1 |
| 93BR029.4 | AF005495 | 6 |
| 90CF056.1 | AF005496 | 3 |
| 94CY032.3 | AF049337 | 7 |
| 94CY017.41 | — | 10 |
| 96ZM651.8 | — | 8 |
| 96ZM751.3 | — | 9 |
| 94IN476.104 | — | 11 |

The nucleic acids of the invention may be present in vectors or host cells in tissue culture or other media. The nucleic acids of the invention may also be isolated and substantially purified by methods known in the art.

Nucleic acids of about 17 bases to about 35 bases in length are particularly preferred for use as primers in PCR amplification (see, e.g., the primers UP1A and R/U5 (17 mer and 22 mer, respectively) and UP1AMlu1 and Low1Mlu1 (28 mer and 35 mer respectively)). Nucleic acids of about 14 to about 25 bases in length are particularly preferred for use in nucleotide arrays. (See, eg., ref. 108, which uses 20 to 25 mers).

The present invention also relates to vectors and host cells comprising the nucleic acids of the invention.

The present invention also relates to compositions comprising one or more of the nucleic acids, vectors, and/or host cells of the invention.

The present invention further relates to methods of using the nucleic acids, vectors, and/or host cells of the invention, and/or compositions thereof. For example, the invention relates to the use of nucleic acids of the invention as diagnostic agents to detect the presence or absence of non-subtype B HIV-1 viruses in a sample.

The present invention also relates to a method for detecting the presence of HIV-1 viruses which are related to the viruses of this invention in a mammal, using the nucleic acids of this invention.

In one embodiment, the detection method involves analyzing DNA obtained from a mammal suspected of harboring HIV-1 viruses. DNA can be isolated by methods well known in the art.

The methods for analyzing the DNA for the presence of the viruses of this invention include Southern blotting (86), dot and slot hybridization (87), and nucleotide arrays (see, e.g., U.S. Pat. Nos. 5,445,934 and 5,733,729).

The nucleic acid probes used in the detection methods set forth above are derived from nucleic acid sequences shown in FIGS. 13A–13Z (SEQ ID NOS: 1 to 11). The size of such probes is at least 10–12 bases long, more usually at least about 19 bases long, more usually from about 200 to about 500 bases, and often exceeding about 1000 bases.

The nucleic acid probes of this invention may be DNA or RNA. Nucleic acids can be synthesized using any of the known methods of nucleotide synthesis (see, e.g., refs. 88, 89, 90), or they can be isolated fragments of naturally occurring or cloned DNA. In addition, those skilled in the art would be aware that nucleotides can be synthesized by automated instruments sold by a variety of manufacturers or can be commercially custom ordered and prepared. The probes of this invention may also be nucleotide analogs, such as nucleotides linked by phosphodiester, phosphorothiodiester, methylphosphonodiester, or methylphosphonothiodiester moieties (91) and peptide nucleic acids (PNAs), in which the sugar-phosphate backbone of the polynucleotide is replaced with a polyamide or "pseudopeptide" backbone (92).

The nucleic acid probes can be labeled using methods known to one skilled in the art. Such labeling techniques can include radioactive labels, biotin, avidin, enzymes and fluorescent molecules (93).

The nucleic acid probes used in the detection methods set forth above are derived from sequences substantially homologous to one or more of the sequences shown in FIGS. 13A–13Z (SEQ ID NOS: 1 to 11), or their complementary sequences. By "substantially homologous", as used throughout the specification and claims to describe the nucleic acid sequence of the present invention, is meant a high level of homology between the nucleic acid sequence and one or more of the sequences of FIGS. 13A–13Z (SEQ ID NOS: 1 to 11), or its complementary sequence. Preferably, the level of homology is in excess of 80%, more preferably in excess of 90%, with a preferred nucleic acid sequence being in excess of 95% homologous with a portion of one or more of the sequences shown in FIGS. 13A–13Z (SEQ ID NOS: 1 to 11), or its complement. The size of such probes is usually at least 20 nucleotides, more usually from about 200 to 500 nucleotides, and often exceeding 1000 nucleotides.

Although complete complementarity is not necessary, it is preferred that the probes are made completely complementary to the corresponding portion of the genome, mRNA or cDNA target of at least one of the 11 viruses of this invention.

The probes can be packaged into diagnostic kits. Diagnostic kits may include ingredients for labeling and other reagents and materials needed for the particular hybridization protocol in addition to the probes.

In another embodiment of the invention, the detection method comprises analyzing the RNA of a mammal for the presence of HIV-1 viruses which are related to one or more of the 11 the viruses of this invention. RNA can be isolated by methods well known in the art.

The methods for analyzing the RNA for the presence of the viruses of this invention include Northern blotting (94), dot and slot hybridization, filter hybridization (95), RNase protection (93), and reverse-transcription polymerase chain reaction (RT-PCR) (96). A preferred method is RT-PCR. In this method, the RNA can be reverse transcribed to first strand cDNA using a nucleic acid primer or primers derived from one or more of the nucleotide sequences shown in FIGS. 13A–13Z (SEQ ID NOS: 1 to 11). Once the cDNAs are synthesized, PCR amplification is carried out using pairs of primers designed to hybridize with sequences in the genomes of one or more of the non-subtype B HIV-1 viruses of this invention which are an appropriate distance apart (at least about 50 bases) to permit amplification of the cDNA and subsequent detection of the amplification product. Each primer of a pair is a single-stranded nucleic acid of about 20 to about 60 bases in length where one primer (the "upstream" primer) is complementary to the original RNA and the second primer (the "downstream" primer) is complementary to the first strand of cDNA generated by reverse transcriptions of the RNA. The target sequence is generally about 100 to about 300 bases in length but can be as large as 500–1500 bases or more, e.g., 9,000 bases. Optimization of the amplification reaction to obtain sufficiently specific hybridization to the nucleotide sequences of these viruses is well within the skill in the art and is preferably achieved by adjusting the annealing temperature.

The amplification products of PCR can be detected either directly or indirectly. In one embodiment, direct detection of the amplification products is carried out via labeling of primer pairs. Labels suitable for labeling the primers of the present invention are known to one skilled in the art and include radioactive labels, biotin, avidin, enzymes and fluorescent molecules. The desired labels can be incorporated into the primers prior to performing the amplification reaction. Alternatively, the desired labels can be incorporated into the primer extension products during the amplification reaction in the form of one or more labeled dNTPs. In one embodiment of the present invention, the labeled amplified PCR products can be detected by agarose gel electrophoresis followed by ethidium bromide staining and visualization under ultraviolet light or via direct sequencing of the PCR-products. The labeled amplified PCR products can also be detected by binding to immobilized oligonucleotide arrays.

In yet another embodiment, unlabelled amplification products can be detected via hybridization with labeled nucleic acid probes in methods known to one skilled in the art, such as dot or slot blot hybridization or filter hybridization.

The invention also relates to methods of using these nucleic acids to produce polypeptides in vitro or in vivo.

In one embodiment of the invention, a recombinant method of making a polypeptide of the invention comprises:
  (a) preparing a nucleic acid capable of directing a host cell
      to produce a polypeptide encoded by the genome of any
      one of the non-subtype B HIV-1 viruses of this invention;

(b) cloning the nucleic acid into a vector capable of being transferred into and replicated in a host cell, such vector containing operational elements for expressing the nucleic acid, if necessary;

(c) transferring the vector containing the nucleic acid and operational elements into a host cell capable of expressing the polypeptide;

(d) growing the host under conditions appropriate for expression of the polypeptide; and (e) harvesting the polypeptide.

The present invention also relates to non-recombinant methods of making the polypeptides and nucleic acids of the invention. In addition to synthetic methods, the non-recombinant methods involve culturing the viruses of this invention in cell lines, preferably in uninfected human peripheral blood mononuclear cells, under conditions appropriate for expression of the polypeptides and nucleic acids. This invention thus also relates to the polypeptides and nucleic acids produced by the virus in cell culture. The polypeptides and nucleic acids may be isolated and purified by methods known in the art.

The vectors contemplated for use in the present invention include any vectors into which a nucleic acid sequence as described above can be inserted, along with any preferred or required operational elements, and which vector can then be subsequently transferred into a host cell and, preferably, replicated in such cell. Preferred vectors are those whose restriction sites have been well documented and which contain the operational elements preferred or required for transcription of the nucleic acid sequence. Vectors may also be used to prepare large amounts of nucleic acids of the invention, which may be used, e.g., to prepare probes or other nucleic acid constructs.

When expression of a polypeptide is desired, the "operational elements" as discussed herein include at least one promoter sequence capable of initiating transcription of the nucleic acid sequence, at least one leader sequence, at least one terminator codon and/or termination signal, and any other DNA sequences necessary or preferred for appropriate transcription and subsequent translation of the vector nucleic acid. In particular, it is contemplated that such vectors will preferably contain at least one origin of replication recognized by the host cell along with at least one selectable marker.

Preferred expression vectors of this invention are those which function in bacterial and/or eukaryotic cells. Examples of vectors which function in eukaryotic cells include, but are not limited to Venezuelan equine encephalitis virus vectors, simian virus vectors, vaccinia virus vectors, adenovirus vectors, herpes virus vectors, or vectors based on retroviruses, such as murine leukemia virus, or HIV or other lentivirus (97).

The selected expression vector may be transfected into a suitable bacterial or eukaryotic cell system for purposes of expressing the recombinant polypeptide. Eukaryotic cell systems include but are not limited to cell lines such as HeLa, COS-1, 293T, MRC-5, or CV-1 cells. Primary human cells, such as lymph node cells, macrophages, etc., are also useful in practicing the invention.

The expressed polypeptides may be detected directly by methods known in the art including, but not limited to, Coomassie blue staining and Western blotting or indirectly, such as in detection of the expression product of a reporter gene, such as luciferase.

In another embodiment of the invention, the method comprises administering a composition comprising a vector comprising a nucleic acid of the invention to a mammal to produce a polypeptide in vivo.

The present invention also relates to polypeptides encoded by and/or derived from the nucleotide sequences of this invention. These polypeptides may be natural, synthetic or produced by recombinant methods. Polypeptides can be obtained as a crude lysate or can be purified by standard protein purification procedures known in the art which may include differential precipitation, molecular size exclusion chromatography, ion-exchange chromatography, isolectric focusing, gel electrophoresis and affinity and immunoaffinity chromatography. The polypeptides may be purified by passage through a column containing a resin which has bound thereto antibodies specific for an open reading frame (ORF) polypeptide. The present invention also relates to compositions comprising one or more of the polypeptides of the invention.

A polypeptide or amino acid sequence derived from a designated nucleic acid sequence refers to a polypeptide having an amino acid sequence identical to that of a polypeptide encoded by the sequence, or a portion thereof wherein the portion consists of at least 6–8 amino acids, and more preferably at least 10 amino acids, and more preferably at least 11–15 amino acids, and most preferably at least 30 amino acids or which is immunologically cross-reactive with a polypeptide encoded by the sequence. The polypeptide may also be larger, e.g., at least 100 amino acids in length, depending on the desired use of the polypeptide. Polypeptides from the V3-loop region and the "crown" of gp41 of Env are particularly preferred.

A recombinant or derived polypeptide is not necessarily translated from a designated nucleic acid sequence; it may be generated in any manner, including for example, chemical synthesis, or expression of a recombinant expression system, or isolation from any of the 11 HIV-1 viruses of this invention.

It should be noted that the nucleotide sequences described herein represent one embodiment of the present invention. Due to the degeneracy of the genetic code, it is to be understood that numerous choices of nucleotides may be made that will lead to a sequence capable of directing production of the polypeptides set forth above. As such, nucleic acid sequences which are functionally equivalent to the sequences described herein are intended to be encompassed within the present invention. For example, preferred codons which are appropriate to the host cell may be used (see, e.g., WO 98/34640), or the sequence may be modified to reduce the effect of any inhibitory/instability sequences and to provide for Rev-independent gene expression. (98).

The polypeptides of this invention consist of at least 6–12 amino acids, more preferably at least 13–18 amino acids, even more preferably at least 19–24 amino acids and most preferably at least 25–30 amino acids encoded by, or otherwise derived from, any one of the genomic sequences shown in FIGS. 13A–13Z (SEQ ID NOS: 1 to 11).

The present invention further relates to the use of polypeptides of the invention as diagnostic agents.

In one embodiment, the polypeptides of the invention can be used in immunoassays for detecting the presence of antibodies against non-subtype B HIV-1 viruses in a mammal and for diagnosing the presence of infection of any of these viruses in a mammal.

For the purposes of the present invention, "mammal" as used throughout the specification and claims, includes, but is not limited to humans, chimpanzees, mangabeys, other primates.

In a preferred embodiment, test serum is reacted with a solid phase reagent having a surface-bound polypeptide of this invention as an antigen. The solid surface reagent can be prepared by known techniques for attaching polypeptides to solid support material. These attachment methods include non-specific adsorption of the polypeptide to the support or covalent attachment of the polypeptide to a reactive group on the support. After reaction of the antigen with an antibody against any one of the viruses of this invention in the serum, unbound serum components are removed by washing and the antigen-antibody complex is reacted with a secondary antibody such as labeled anti-human antibody. The label may be an enzyme that is detected by incubating the solid support in the presence of a suitable fluorimetric or colorimetric reagent. Other detectable labels may also be used, such as radiolabels or colloidal gold, and the like.

Immunoassays of the present invention may be a radioimmunoassay, Western blot assay, immunofluorescent assay, enzyme immunoassay, chemiluminescent assay, immunohistochemical assay and the like. Standard techniques for ELISA are well known in the art. Such assays may be a direct, indirect, competitive, or noncompetitive immunoassay as described in the art (see, e.g., ref. 99). Biological samples appropriate for such detection assays include, but are not limited to serum, liver, saliva, lymphocytes or other mononuclear cells.

Polypeptides of the invention may be prepared in the form of a kit, alone, or in combinations with other reagents such as secondary antibodies, for use in immunoassays.

In yet another embodiment, the polypeptides of the invention can be used as immunogens to raise antibodies and/or stimulate cellular immunity in a mammal.

The immunogen may be a partially or substantially purified peptide. Alternatively, the immunogen may be a cell, cell lysate from cells transfected with a recombinant expression vector, or a culture supernatant containing the expressed polypeptide. The immunogen may comprise one or more structural proteins, and/or one or more non-structural proteins of the HIV-1 clones of this invention, or a mixture thereof.

The effective amount of polypeptide per unit dose sufficient to induce an immune response depends, among other things, on the species of mammal inoculated, the body weight of the mammal and the chosen inoculation regimen, as well as the presence or absence of an adjuvant, as is well known in the art. Inocula typically contain polypeptide concentrations of about 1 microgram to about 50 milligrams per inoculation (dose), preferably about 10 micrograms to about 10 milligrams per dose, most preferably about 100 micrograms to about 5 milligrams per dose.

The term "unit dose" as it pertains to the inocula refers to physically discrete units suitable as unitary dosages for mammals, each unit containing a predetermined quantity of active material (polypeptide) calculated to produce the desired immunogenic effect in association with the required diluent.

Inocula are typically prepared as a solution in a physiologically acceptable carrier such as saline, phosphate-buffered saline and the like to form an aqueous pharmaceutical composition.

The route of inoculation of the polypeptides of the invention is typically parenteral and is preferably intramuscular, sub-cutaneous and the like. The dose is administered at least once. In order to increase the antibody level, at least one booster dose may be administered after the initial injection, preferably at about 4 to 6 weeks after the first dose. Subsequent doses may be administered as indicated.

To monitor the antibody response of individuals administered the compositions of the invention, antibody titers may be determined. In most instances it will be sufficient to assess the antibody titer in serum or plasma obtained from such an individual. Decisions as to whether to administer booster inoculations or to change the amount of the composition administered to the individual may be at least partially based on the titer.

The titer may be based on an immunobinding assay that measures the concentration of antibodies in the serum which bind to a specific antigen. The ability to neutralize in vitro and in vivo biological effects of the viruses of this invention may also be assessed to determine the effectiveness of the immunization.

For all therapeutic, prophylactic and diagnostic uses, the polypeptide of the invention, alone or linked to a carrier, as well as antibodies and other necessary reagents and appropriate devices and accessories may be provided in kit form so as to be readily available and easily used.

Where immunoassays are involved, such kits may contain a solid support, such as a membrane (e.g., nitrocellulose), a bead, sphere, test tube, microtiter well, rod, and so forth, to which a receptor such as an antibody specific for the target molecule will bind. Such kits can also include a second receptor, such as a labeled antibody. Such kits can be used for sandwich assays. Kits for competitive assays are also envisioned.

The immunogens of this invention can also be generated by the direct administration of nucleic acids of this invention to a subject. DNA-based vaccination has been shown to stimulate humoral and cellular responses to HIV-1 antigens in mice (100–103) and macaques (103, 104). More recent studies in infected chimpanzees have shown a possible application of this strategy in HIV-1-infected humans: DNA vaccination of HIV-1-infected chimpanzees with a construct that drives expression of HIV-1 env and rev appeared well-tolerated, and immunized animals demonstrated a boost in antibody response followed by a >1 log decrease in their virus loads (104). A DNA-based vaccine containing HIV-1 env and rev genes was injected into HIV-infected human patients in three doses (30, 100 or 300 micrograms) at 10-week intervals. Increased antibodies against gp120 were observed in the 100 and 300 _g groups. Increases were also noted in cytotoxic T lymphocyte (CTL) activity against gp160-bearing targets and in lymphocyte proliferative activity (105, 106). DNA-based vaccines containing HIV gag genes, with modification of the viral nucleotide sequence to incorporate host-preferred codons (see, e.g., WO 98/34640), and/or to reduce the effect of inhibitory/instability sequences (see, e.g., ref. 98), have likewise been described.

Therefore, it is anticipated that the direct injection of RNA or DNA vectors of this invention encoding viral antigen can be used for endogenous expression of the antigen to generate the viral antigen for presentation to the immune system without the need for self-replicating agents or adjuvants, resulting in the generation of antigen-specific CTLs and protection from a subsequent challenge with a homologous or heterologous strain of virus.

CTLs in both mice and humans are capable of recognizing epitopes derived from conserved internal viral proteins and are thought to be important in the immune response against viruses. By recognition of epitopes from conserved viral proteins, CTLs may provide cross-strain protection. CTLs specific for conserved viral antigens can respond to different strains of virus, in contrast to antibodies, which are generally strain-specific.

Thus, direct injection of RNA or DNA encoding the viral antigen has the advantage of being without some of the limitations of direct peptide delivery or viral vectors (see, e.g., ref. 107 and the discussions and references therein).

Furthermore, the generation of high-titer antibodies to expressed proteins after injection of DNA indicates that this may be a facile and effective means of making antibody-based vaccines targeted towards conserved or non-conserved antigens, either separately or in combination with CTL vaccines targeted towards conserved antigens. These may also be used with traditional peptide vaccines, for the generation of combination vaccines. Furthermore, because protein expression is maintained after DNA injection, the persistence of B and T cell memory may be enhanced, thereby engendering long-lived humoral and cell-mediated immunity.

Nucleic acids encoding a polypeptide of this invention can be introduced into animals or humans in a physiologically or pharmaceutically acceptable carrier using one of several techniques such as injection of DNA directly into human tissues; electroporation or transfection of the DNA into primary human cells in culture (ex vivo), selection of cells for desired properties and reintroduction of such cells into the body, (said selection can be for the successful homologous recombination of the incoming DNA to an appropriate preselected genomic region); generation of infectious particles containing the gag and/or other genes encoded by the viruses of this invention, infection of cells ex vivo and reintroduction of such cells into the body; or direct infection by said particles in vivo. Substantial levels of polypeptide will be produced leading to an efficient stimulation of the immune system.

Also envisioned are therapies based upon vectors, such as viral vectors containing nucleic acid sequences coding for the polypeptides described herein. These molecules, developed so that they do not provoke a pathological effect, will stimulate the immune system to respond to the polypeptides.

The effective amount of nucleic acid immunogen per unit dose to induce an immune response depends, among other things, on the species of mammal inoculated, the body weight of the mammal and the chosen inoculation regimen, as is well known in the art. Inocula typically contain nucleic acid concentrations of about 1 microgram to about 50 milligrams per inoculation (dose), preferably about 10 micrograms to about 10 milligrams per dose, most preferably about 100 micrograms to about 5 milligrams per dose.

Immunization can be conducted by conventional methods. For example, the immunogen can be used in a suitable diluent such as saline or water, or complete or incomplete adjuvants. Further, the immunogen may or may not be bound to a carrier. While it is possible for the immunogen to be administered in a pure or substantially pure form, it is preferable to present it as a pharmaceutical composition, formulation or preparation.

The formulations of the present invention, both for veterinary and for human use, comprise an immunogen as described above, together with one or more physiologically or pharmaceutically acceptable carriers and optionally other therapeutic ingredients. The carrier(s) must be "acceptable" in the sense of being compatible with the other ingredients of the formulation and not deleterious to the recipient thereof. The formulations may conveniently be presented in unit dosage form and may be prepared by any method well-known in the pharmaceutical art. The immunogen can be administered by any route appropriate for antibody production such as intravenous, intraperitoneal, intramuscular, subcutaneous, and the like. The immunogen may be administered once at or periodic intervals until a significant titer of antibody against any of the 11 viruses of this invention is produced. The antibody may be detected in the serum using an immunoassay. The host serum or plasma may be collected following an appropriate time interval to provide a composition comprising antibodies reactive with the virus particle or encoded polypeptide. The gamma globulin fraction or the IgG antibodies can be obtained, for example, by use of saturated ammonium sulfate or DEAE Sephadex, or other techniques known to those skilled in the art.

In addition to its use to raise antibodies, the administration of the immunogens of the present invention may be for use as a vaccine for either a prophylactic or therapeutic purpose. When provided prophylactically, a vaccine(s) of the invention is provided in advance of any exposure to any one or more of the 11 non-subtype B viruses of this invention or in advance of any symptoms due to infection of these viruses. The prophylactic administration of a vaccine(s) of the invention serves to prevent or attenuate any subsequent infection of these viruses in a mammal. When provided therapeutically, a vaccine(s) of the invention is provided at (or shortly after) the onset of infection or at the onset of any symptom of infection or any disease or deleterious effects caused by these viruses. The therapeutic administration of the vaccine(s) serves to attenuate the infection or disease. The vaccine(s) of the present invention may, thus, be provided either prior to the anticipated exposure to the viruses of this invention or after the initiation of infection.

In another embodiment, the polypeptides of the invention can be used to prepare antibodies against epitopes of the viruses of this invention that are useful in diagnosis.

The term "antibodies" is used herein to refer to immunoglobulin molecules and immunologically active portions of immunoglobulin molecules. Exemplary antibody molecules are intact immunoglobulin molecules, substantially intact immunoglobulin molecules and portions of an immunoglobulin molecule, including those portions known in the art as Fab, Fab', $F(ab')_2$ and F(v) as well as chimeric antibody molecules.

An antibody of the present invention is typically produced by immunizing a mammal with an immunogen or vaccine of the invention. In one embodiment, the immunogen or vaccine contains one or more polypeptides of the invention, or a structurally and/or antigenically related molecule, to induce, in the mammal, antibody molecules having immunospecificity for the immunizing peptide or peptides. The peptide(s) or related molecule(s) may be monomeric, polymeric, conjugated to a carrier, and/or administered in the presence of an adjuvant. In another embodiment, the immunogen or vaccine contains one or more nucleic acids encoding one or more polypeptides of the invention, or one or more nucleic acids encoding structurally and/or antigenically related molecules, to induce, in the mammal, the production of the immunizing peptide or peptides. The antibody molecules may then be collected from the mammal if they are to be used in immunoassays or for providing passive immunity.

The antibody molecules of the present invention may be polyclonal or monoclonal. Monoclonal antibodies may be produced by methods known in the art. Portions of immunoglobulin molecules may also be produced by methods known in the art.

The antibody of the present invention may be contained in various carriers or media, including blood, plasma, serum (e.g., fractionated or unfractionated serum), hybridoma supernatants and the like. Alternatively, the antibody of the present invention is isolated to the extent desired by well known techniques such as, for example, by using DEAE SEPHADEX, or affinity chromatography. The antibodies may be purified so as to obtain specific classes or subclasses of antibody such as IgM, IgG, IgA, IgG$_1$, IgG$_2$, IgG$_3$, IgG4 and the like. Antibody of the IgG class are preferred for purposes of passive protection.

The presence of the antibodies of the present invention, either polyclonal or monoclonal, can be determined by, but are not limited to, the various immunoassays described above.

The antibodies of the present invention have a number of diagnostic and therapeutic uses. The antibodies can be used as an in vitro diagnostic agent to test for the presence of any one or more of the 11 HIV-1 viruses of this invention in biological samples in standard immunoassay protocols. Preferably, the assays which use the antibodies to detect the presence of these viruses in a sample involve contacting the sample with at least one of the antibodies under conditions which will allow the formation of an immunological complex between the antibody and the viral antigen that may be present in the sample. The formation of an immunological complex if any, indicating the presence of one or more of these viruses in the sample, is then detected and measured by suitable means. Such assays include, but are not limited to, radioimmunoassays, (RIA), ELISA, indirect immunofluorescence assay, Western blot and the like. The antibodies may be labeled or unlabeled depending on the type of assay used. Labels which may be coupled to the antibodies include those known in the art and include, but are not limited to, enzymes, radionucleotides, fluorogenic and chromogenic substrates, cofactors, biotin/avidin, colloidal gold and magnetic particles. Modification of the antibodies allows for coupling by any known means to carrier proteins or peptides or to known supports, for example, polystyrene or polyvinyl microtiter plates, glass tubes or glass beads and chromatographic supports, such as paper, cellulose and cellulose derivatives, and silica.

Such assays may be, for example, of direct format (where the labeled first antibody reacts with the antigen), an indirect format (where a labeled second antibody reacts with the first antibody), a competitive format (such as the addition of a labeled antigen), or a sandwich format (where both labeled and unlabelled antibody are utilized), as well as other formats described in the art. In one such assay, the biological sample is contacted with antibodies of the present invention and a labeled second antibody is used to detect the presence of any one of the HIV-1 viruses of this invention, to which the antibodies are bound.

The antibodies of the present invention are also useful as a means of enhancing the immune response.

The antibodies may be administered with a physiologically or pharmaceutically acceptable carrier or vehicle therefor. A physiologically acceptable carrier is one that does not cause an adverse physical reaction upon administration and one in which the antibodies are sufficiently soluble and retain their activity to deliver a therapeutically effective amount of the compound. The therapeutically effective amount and method of administration of the antibodies may vary based on the individual patient, the indication being treated and other criteria evident to one of ordinary skill in the art. A therapeutically effective amount of the antibodies is one sufficient to reduce the level of infection by one or more of the viruses of this invention or attenuate any dysfunction caused by viral infection without causing significant side effects such as non-specific T cell lysis or organ damage.

The route(s) of administration useful in a particular application are apparent to one or ordinary skill in the art. Routes of administration of the antibodies include, but are not limited to, parenteral, and direct injection into an affected site. Parenteral routes of administration include but are not limited to intravenous, intramuscular, intraperitoneal and subcutaneous.

The present invention includes compositions of the antibodies described above, suitable for parenteral administration including, but not limited to, pharmaceutically acceptable sterile isotonic solutions. Such solutions include, but are not limited to, saline and phosphate buffered saline for intravenous, intramuscular, intraperitoneal, or subcutaneous injection, or direct injection into a joint or other area.

Antibodies for use to elicit passive immunity in humans are preferably obtained from other humans previously inoculated with pharmaceutical compositions comprising one or more of the polypeptides of the invention. Alternatively, antibodies derived from other species may also be used. Such antibodies used in therapeutics suffer from several drawbacks such as a limited half-life and propensity to elicit an immune response. Several methods are available to overcome these drawbacks. Antibodies made by these methods are encompassed by the present invention and are included herein. One such method is the "humanizing" of non-human antibodies by cloning the gene segment encoding the antigen binding region of the antibody to the human gene segments encoding the remainder of the antibody. Only the binding region of the antibody is thus recognized as foreign and is much less likely to cause an immune response.

In providing the antibodies of the present invention to a recipient mammal, preferably a human, the dosage of administered antibodies will vary depending upon such factors as the mammal's age, weight, height, sex, general medical condition, previous medical history and the like.

In general, it is desirable to provide the recipient with a dosage of antibodies which is in the range of from about 5 mg/kg to about 20 mg/kg body weight of the mammal, although a lower or higher dose may be administered. In general, the antibodies will be administered intravenously (IV) or intramuscularly (IM).

The invention also relates to the use of antisense nucleic acids to inhibit translation of peptides encoded by the HIV-1 viruses of this invention. The antisense nucleic acids are complementary to the viral mRNAs encoding peptides of this invention. The antisense nucleic acids may be in the form of synthetic nucleic acids or they may be encoded by a nucleotide construct, or they may be semi-synthetic. The antisense nucleic acids may be delivered to the cells using methods known to those skilled in the art.

Kits designed for diagnosis of the HIV-1 viruses of this invention in a biological sample can be constructed by packaging the appropriate materials, including the nucleic acids and/or polypeptides of this invention and/or antibodies which specifically react with antigens of one or more of these viruses, along with other reagents and materials required for the particular assay.

The present invention further relates to computer-generated alignments of any one or more of the nucleotide sequences shown in FIGS. 13A–13Z (SEQ ID NOS: 1 to 11). Computer analysis of the nucleotide sequences, such as the one shown in FIG. 13, can be carried out using commercially available computer program known to one skill in the art.

In one embodiment, the sequences shown in FIGS. 13A–13Z (SEQ ID NOS: 1 to 11) are aligned by the computer program CLUSTAL (67) and adjusted with multiple-aligned sequence editor (12). The computer analysis results in the distribution of 11 sequences into various genotypes. Five of these sequences represent non-recombinant members of HIV-1 subtypes, and the other six sequences represent HIV-1 intersubtype recombinants.

The grouping of the molecular clones into mosaic and non-mosaic genotypes is shown below:

| Name of Clone | Genotypes |
|---|---|
| 94CY017.41 | A/? |
| 94IN476.104 | C |
| 96ZM651.8 | C |
| 96ZM751.3 | C |
| 93BR020.1 | F |
| 90CF056.1 | H |
| 92R W009.6 | A/C |
| 92NG083.2 | A/G |
| 92NG003.1 | A/G |
| 93BR029.4 | B/F |
| 94CY032.3 | A/G/I |

For those sequences representing recombinant members of HIV-1, a variety of phylogenetic methods were used to further characterize the subtype composition.

The multiple computer-generated alignments of nucleotide sequences are shown in FIGS. 13A–13Z. The multiple computer-generated alignments of encoded amino acid sequences are shown in FIGS. 14–22. These alignments serve to highlight regions of homology and non-homology between different sequences and hence, can be used by one skilled in the art to design oligonucleotides and polypeptides useful as reagents in diagnostic assays for HIV-1.

The following examples illustrate certain embodiments of the present invention, but should not be construed as limiting its scope in any way. Certain modifications and variations will be apparent to those skilled in the art from the teachings of the forgoing disclosure and the following examples, and these are intended to be encompassed by the spirit and scope of the invention.

EXAMPLE 1

Materials and Methods

Virus Isolates

All viruses used were propagated in normal donor peripheral blood mononuclear cells (PBMCs) and thus represent primary isolates. Their biological phenotype (SI/NSI), year of isolation, relevant epidemiological and clinical information, as well as appropriate references are summarized in Table 1. For consistency, isolates are labeled according to WHO nomenclature (28). Preliminary subtype classification was made on the basis of partial env and/or gag gene sequences (1,17,19,43).

Amplification of Near Complete HIV-1 Genomes Using Long PCR Methods (Near) full length HIV-1 genomes were amplified from short-term cultured PBMC DNA essentially as described (18,56) using the GeneAmp XL kit (Perkin Elmer Cetus, Foster City, Calif.) and primers spanning the tRNA primer binding site (upstream primer UPIA: 5'-AGTGGCGCCCGAACAGG-3') (SEQ ID NO: 109) and the R/U5 junction in the 3' long terminal repeat (downstream primer Low2: 5'-TGAGGCTTAAGCAGTGGGTTTC-3') (SEQ ID NO: 110). Some isolates were amplified with primers containing Mlu1 restriction enzyme sites to facilitate subsequent subcloning into plasmid vectors (upstream primer UP1AMlu1: 5'-TCTCTacgcgtGGCGCCCGAACAGGGAC-3' (SEQ ID NO: 111); downstream primer Low1Mlu1: 5'-ACCAGacgcgtACAACAGACGGGCACACACTA-CTT-3' (SEQ ID NO: 112); lower case letters indicate the Mlu1 restriction site). Whenever possible, PBMC DNAs were diluted prior to PCR analysis to attempt amplification from single proviral templates. Cycling conditions included a hot start (94° C., 2 min), followed by 20 cycles of denaturation (94° C.; 30 sec) and extension (68° C.; 10 min), followed by 17 cycles of denaturation (94° C.; 30 sec) and extension (68° C., 10 min) with 15 second increments per cycle. PCR products were visualized by agarose gel electrophoresis and subcloned into pCRII by T/A overhang or following cleavage with Mlu1 into a modified pTZ18 vector (pTZ18Mlu1) containing a unique Mlu1 site in its polylinker. Transformations were performed in INVαF' cells, and colonies were screened by restriction enzyme digestion for full length inserts (transformation efficiencies were generally poor, yielding only a few recombinant colonies; however, once subcloned, full length genomes were stable in their respective vectors). One full length clone per isolate was randomly chosen for subsequent sequence analysis.

Construction of a Full Length and Infectious Molecular Clone of 94UG114.1

A 674 bp fragment spanning most of the viral LTR (lacking 1–92 of U3 sequences) as well as the untranslated leader sequence preceding gag, was amplified from 94UG114 PBMC DNA, using primers and conditions described previously (18). After sequence confirmation, this LTR fragment was cloned into the pTZ18Mlu1 vector, which was subsequently cleaved with Nar1 (in the primer binding site) and Mlu1 (in the polylinker) to allow the insertion of the 94UG114.1 long PCR product cleaved with the same restriction enzymes. The resulting plasmid clone comprised a full length 94UG 114.1 genome with 3' and 5' LTR fragments containing all regulatory elements necessary for viral replication. A similar strategy could be used to construct replication competent genomes for all 11 clones reported in this application.

Sequence Analysis of HIV-1 Genomes

A number of the clones described herein were sequenced using the shotgun sequencing approach (37). Briefly, viral genomes were released from their respective plasmid vectors by cleavage with the appropriate restriction enzymes, purified by gel electrophoresis, and sonicated (Model XL2020 Sonicator; Heat System Inc., Framingdale, N.Y.) to generate randomly sheared DNA fragments 600–1,000 bp in length. Following purification by gel electrophoresis, fragments were end-repaired using T4 DNA polymerase and Klenow enzyme and ligated into SmaI digested and dephosphorylated M13 or pTZ18 vectors. Approximately 200 shotgun clones were sequenced for each viral genome using cycle sequencing and dye terminator methodologies on an automated DNA sequenator (Model 377A; Applied Biosystems, Inc.). Sequences were determined for both strands of DNA. Other clones were sequenced directly using the primer walking approach (primers were designed approximately every 300 bp along the genome for both strands). Proviral contigs were assembled from individual sequences using the SEQUENCHER program (Gene Codes Corporation, Ann Arbor, Mich.). Sequences were analyzed using EUGENE (Baylor College of Medicine, Houston, Tex.) and MASE (12).

Phylogenetic Tree Analysis

Phylogenetic relationships of the newly derived viruses were estimated from sequence comparisons with previously reported representatives of HIV-1 group M (45). Multiple gag and env sequence alignments were obtained from the Los Alamos sequence database (http://hiv-web.lan1.gov/HTML/alignments.html). Newly derived gag and env sequences were added to these alignments using the CLUSTAL W profile alignment option (67) and adjusted manually using the alignment editor MASE (12). All partial sequences were removed from these alignments. Sites where there was a gap in any of the remaining sequences, as well as areas of uncertain alignment, were excluded from all sequence comparisons. Pairwise evolutionary distances were estimated using Kimura's two parameter method to correct for superimposed substitutions (26). Phylogenetic trees were constructed using the neighbor-joining method (55), and the reliability of topologies was estimated by performing bootstrap analysis using 1,000 replicates (13). NJPLOT was used to draw trees for illustrations (49). Phylogenetic relationships were also determined using maximum-parsimony (with repeated randomized input orders; ten iterations) as well as maximum-likelihood approaches, implemented using the programs DNAPARS and DNAML from the PHYLIP package (14).

Complete Genome Alignment

All newly derived HIV-1 genome sequences were aligned with previously reported (45) full length representatives of HIV-1 subtype A (U445), B (LAI, RF, OYI, MN, SF2), C (C2220), D (ELI, NDK, Z2Z6), and "E" (90CF402.1, 93TH253.3, CM240) as well as SIVcpzGAB as an outgroup using the CLUSTAL W (67) profile alignment option (the alignment includes the untranslated leader sequence, gag, pol, vif, vpr, tat, rev, vpu, env, nef and available 3' LTR sequences). Sequences that needed to be excluded from any particular analysis were removed only after gap-tossing was performed on the complete alignment containing all sequences. This ensured that all positions were comparable in different runs with different sequences.

Diversity Plots

The percent diversity between selected pairs of sequences was determined by moving a window of 500 bp in 10 bp increments along the genome alignment. The divergence values for each pairwise comparison were plotted at the midpoint of the 500 bp segment.

Bootstrap Plots

Bootscanning was performed on neighbor-joining trees using SEQBOOT, DNADIST (using Kimura's correction), NEIGHBOR and CONSENSUS from the PHYLIP package (14) for a window of 500 bp moved along the alignment in increments of 10 bp. 1000 replicates were evaluated for each phylogeny. The program ANALYZE from the bootscanning package (57) was used to examine the clustering of the putative hybrid with representatives of the subtypes presumed to have been involved in the recombination event. The bootstrap values for these sequences were plotted at the midpoint of each window.

Exploratory Tree Analysis

Exploratory tree analysis was performed using the bootstrap plot approach described above, except in this case an increment of 100 bp was used and each neighbor-joining tree was viewed using DRAWTREE from the PHYLIP package (14). In addition, all full length sequences (except known recombinants) were included into the analysis.

Informative Site Analysis

To estimate the location and significance of cross-overs, each putative hybrid sequence was compared with a representative of each of the two subtypes inferred to have been involved in the recombination event, and an appropriate outgroup. Recombination breakpoints were mapped by examining the linear distribution of phylogenetically informative sites supporting the clustering of the hybrid with each of the two "parental" subtypes, essentially as described (52,53). Potential breakpoints were inserted between each pair of adjacent informative sites, and the extent of heterogeneity between the two sides of the breakpoint, with respect to numbers of the two kinds of informative site, was calculated as a 2×2 chi square value; the likely breakpoint was identified as that which gave the maximal chi-square value. Since the alignments contained more than one putative cross-over, this analysis was performed looking for one and two breakpoints at a time, and repeated on subsections of the alignment defined by breakpoints already identified. To assess the probability of obtaining (by chance) chi-square values as high as those observed, 10,000 random permutations of the informative sites were examined.

Nucleotide Sequence Accession Numbers

GenBank accession numbers for several of the (near) full length HIV-1 proviral sequences disclosed in this application are listed in Table 2, and are hereby incorporated by reference.

EXAMPLE 2

Identification of Non-Subtype B HIV-1 Viruses

Molecular Cloning of Non-Subtype B HIV-1 Isolates

Of the geographically diverse HIV-1 isolates described herein, five had previously been classified as members of (group M) subtypes A (92RW009), F (92BR020, 92BR029), and G (92NG003, 92NG083) on the basis of env (17,19) and/or gag sequences (1). One (90CF056) was chosen because it originated from a major epicenter of the African AIDS epidemic. In addition, 90CF056 did not fall into any known subtype at the time of its first genetic characterization (43). Isolates from Zambia (96ZM651 and 96ZM75 1) and India (94IN476) were chosen because of the known subtype C prevalence in those countries. The two isolates from Cyprus (94CY017 and 94CY032) were selected because of the extensive diversity of HIV-1 in the drug user population (29). Table 1 summarizes available demographic and clinical information, as well as biological data concerning the isolate phenotype (SI/NSI). Only viruses grown in normal donor PBMCs were selected for analysis.

TABLE 1

Epidemiological and clinical information for study isolates

| Isolate[a] | Sex[b] | Age | City | Country | Risk factor[c] | Disease status[d] | Antiviral therapy | Year of[d] isolation | Source[e] | Biological phenotype[f] | Preliminary subtype assignment | Refs. |
|---|---|---|---|---|---|---|---|---|---|---|---|---|
| 94CY017.41 | F | 35 | Nicosia | Cyprus | Het | SM | n/a | 1994 | ADARC | n/a | A/? | 29 |
| 94CY032.3 | M | 35 | Nicosia | Cyprus | Ret | AS | n/a | 1994 | ADARC | n/a | G/A/I | 29 |
| 96ZM651.8 | M | 47 | Lusaka | Zambia | Het | SM | n/a | 1996 | UAB | n/a | n/a | n/a |
| 96ZM751.3 | M | 26 | Lusaka | Zambia | Het | SM | No | 1996 | UAB | n/a | n/a | n/a |
| 94IN476.104 | F | n/a | Pune | India | n/a | n/a | No | 1994 | ADARC | n/a | n/a | n/a |
| 93BR020 | M | 52 | Rio de Janeiro | Brazil | Bi | AS | No | 1993 | WHO | SI | F | 19, 72 |

TABLE 1-continued

Epidemiological and clinical information for study isolates

| Isolate[a] | Sex[b] | Age | City | Country | Risk factor[c] | Disease status[d] | Antiviral therapy | Year of isolation[d] | Source[e] | Biological phenotype[f] | Preliminary subtype assignment | Refs. |
|---|---|---|---|---|---|---|---|---|---|---|---|---|
| 90CF056 (U4056) | M | n/a | Bangui | CAR | Het | AS | No | 1990 | PIB | NSI | U | 43 |
| 92RW009 | F | 24 | Kigali | Rwanda | Het | AS | No | 1992 | WHO | NSI | A[h] | 17, 72 |
| 93BR029 | M | 17 | Sao Paulo | Brazil | n/a | AS | No | 1993 | WHO | NSI | F[h] | 19, 72 |
| 92NG083 (JV1083) | F | 27 | Jos | Nigeria | n/a | AIDS | No | 1992 | IHV | NSI | G[h] | 1 |
| 92NG003 (G3) | F | 24 | Jos | Nigeria | Het | AS | n/a | 1992 | IHV | NSI | G[h] | 1 |

[a]Isolates were named according to WHO nomenclature (previous designations are listed in parentheses).
[b]M, male; F, female.
[c]Het, heterosexual contact; Bi, bisexual contact; Hemo, hemophiliac patient.
[d]AS, asymptomatic; SM, symptomatic.
[e]TJU Thomas Jefferson University, Philadelphia, PA; PIB, Pasteur Institute, Bangui, CAR; IHV, Institute of Human Virology, Baltimore, MD; WHO, World Health Organization, Geneva, Switzerland; UAB, University of Alabama.
[f]Determined in MT-2 assay as described (72); NSI, non-syncytium inducing; SI, synctium inducing.
[g]n/a, information not available.
[h]Isolates identified to be recombinant in present study.

The viral genomes were cloned by long PCR methods using primers homologous to the tRNA primer binding site (upstream primer) and the polyadenylation signal in the 3' LTR (downstream primer). This amplification strategy generated (near) full length genomes containing all coding and regulatory regions, except for 70 to 80 bps of 5' unique LTR sequences (U5). All isolates, regardless of subtype classification, yielded long PCR products with the same set of primer pairs. In some instances, genomes were amplified with primers containing Mlu1 restriction enzyme sites. This greatly facilitated subsequent subcloning into a plasmid vector (Table 2).

Sequence Analysis of (Near) Full Length HIV-1 Genomes

All eleven HIV-1 genomes were sequenced in their entirety using either shotgun sequencing or primer walking approaches. The long PCR derived clones ranged in size from 8,952 to 8,999 base pairs, and spanned the genome from the primer binding site to the R/U5 junction of the 3' LTR. Inspection of potential coding regions revealed that all clones contained the expected reading frames for gag, pol, vif, vpr, tat, rev, vpu, env and nef. In addition, all major regulatory sequences, including promotor and enhancer elements in the LTR, the packaging signal, splice sites, etc., appeared to be intact. None of the genomes had major deletions or rearrangements, although inspection of the deduced protein sequences identified inactivating mutations in seven of the eleven clones (Table 2). However, most of these were limited to point mutations in single genes and were thus amenable to repair. Only two genomes (92NG003.1 and 92NG083.2) contained stop codons, small deletions and frameshift mutations in several genes, rendering them multiply defective. Importantly, no inactivating mutations were identified in 93BR020.1 (subtype F), 90CF056.1 (subtype H), and 96ZM651.8 (subtype C), suggesting that these clones encoded biologically active genomes (Table 2). Nucleic acids containing repaired coding sequences, as well as the polypeptides encoded by the repaired coding sequences, are also considered to be a part of the invention.

TABLE 2

Inactivating mutations in near-complete HIV-1 genomes

| Clone | Defective gene(s) | Inframe stop codon[a] | Frameshift mutation[a] | Altered initiation codon[a] | Plasmid vector[d] | GenBank accession number |
|---|---|---|---|---|---|---|
| 93BR020.1 | none | — | — | — | pCR2.1 | AF005494 |
| 90CF056.1 | none | — | — | — | pCR2.1 | AF005496 |
| 92RW009.6 | gag | — | 213 | — | pTZ18 (Mlu1) | U88823 |
| 93BR029.4 | gag | — | 260, 472 | — | pTZ18 (Mlu1) | AF005495 |
| 92NG083.2 | gag, vpu | 360 | 5462[b] | 157 | pTZ18 (Mlu1) | U88826 |
| 92NG003.1[c] | vpr, vpu, nef | — | 5024[b], 5485[b] | 8113 | pTZ18 (Mlu1) | U88825 |
| 96ZM651.8 | none | — | — | — | pTZ18 (Mlu1) | pending |
| 96ZM751.3 | gag/pol/env | 7567 | 1067/2688 | — | pTZ18 (Mlu1) | pending |
| 94IN476.104 | pol/vpr | 3021 | — | — | pTZ18 (Mlu1) | pending |
| 94CY032.3 | vif/env/vpr | 4518/7125 | 5199 | — | pTZ18 (Mlu1) | pending |
| 94CY017.41 | rev | — | — | 5327 | pCRII | pending |

[a]Numbers indicate the position of the inactivating mutation within the sequence.
[b]Frameshift mutations associated with more extensive nucleotide sequence deletions (10–16 bp).
[c]92NG003.1 also has a 33 bp deletion in the V3 loop region of env.
[d]Genomes were either subcloned by T/A overhang into pCRII, or via Mlu1 sites in the primer sequences into pTZ18 (Mlu1).

EXAMPLE 3
Phylogenetic Analyses in Gag and Env Regions

To determine the phylogenetic relationships of the viruses described herein, evolutionary trees from full length gag and env sequences were first constructed. This was done to confirm the authenticity of previously characterized strains, classify the new viruses, and compare viral branching orders in trees from two genomic regions. The results confirmed a broad subtype representation among the selected viruses (FIGS. 1A–1B). Strains fell into six of the seven major (non-B) clades, including three for which full length sequences are not available (i.e., F, G and H). However, comparison of the gag and env topologies also identified three strains with discordant branching orders. 92RW009.6 grouped with subtype C viruses in gag, but with subtype A viruses in env. Similarly, 93BR029.4 clustered with subtype B viruses in gag, but with subtype F viruses in env. 94CY017.41 appeared to cluster within subtype A viruses in env, but fell into an unknown subtype in gag. However, characterization of the latter strain is still ongoing. These different phylogenetic positions were supported by high bootstrap values and thus indicated that these strains were intersubtype recombinants.

EXAMPLE 4
Diversity Plots

To characterize the putative recombinants as well as the other strains in regions outside gag and env, pairwise sequence comparisons with available full length sequences from the database were performed. A multiple genome alignment was generated which included the new sequences as well as U455 (subtype A), LAI, RF, OYI, MN and SF2 (subtype B), C2220 (subtype C), ELI, NDK and Z2Z6 (subtype D), and 90CF402.1, 93TH253.3 and CM240 ("subtype E"). The percent nucleotide sequence diversity between sequence pairs was then calculated for a window of 500 bp moved in steps of 10 bp along the alignment. Importantly, distance values were calculated only after all sites with a gap in any of the sequences were removed from the alignment. This ensured that all comparisons were made across the same sites.

FIGS. 2A–2J depict selected distance plots for the newly characterized viruses. For example in FIG. 2A, 93BR020.1 (putative subtype F) is compared to U455 (subtype A), NDK (subtype D), C2220 (subtype C) and 90CF056.1 (putative subtype H). The resulting plots all exhibit very similar diversity profiles characterized by alternating regions of sequence variability and conservation (values range from 7% divergence near the 5' and 3' ends of pol, to 30% in the segment of env encoding the V3 region). Moreover, the four plots are virtually superimposable, indicating that 92BR020.1 is roughly equidistant from U455, NDK, C2220 and 90CF056.1 over the entire length of its genome. A very similar set of distance curves was also obtained from comparisons of 94CY017.41 with 90CF056.1, 92BR025.8, 93BR020.1, U455, and NDK (FIG. 2B), and from comparisons of both 93BR020.1 and 90CF056.1 with representatives of subtype B and "E" (data not shown). These results indicating that 93BR020.1 and 90CF056.1 are equidistant from each other as well as from members of subtypes A, B, C, D and "E", together with the gag and env phylogenetic trees (FIGS. 1A–1B), suggest that 93BR020.1 and 90CF056.1 represent non-recombinant members of subtypes F and H, respectively.

Figure 2A:
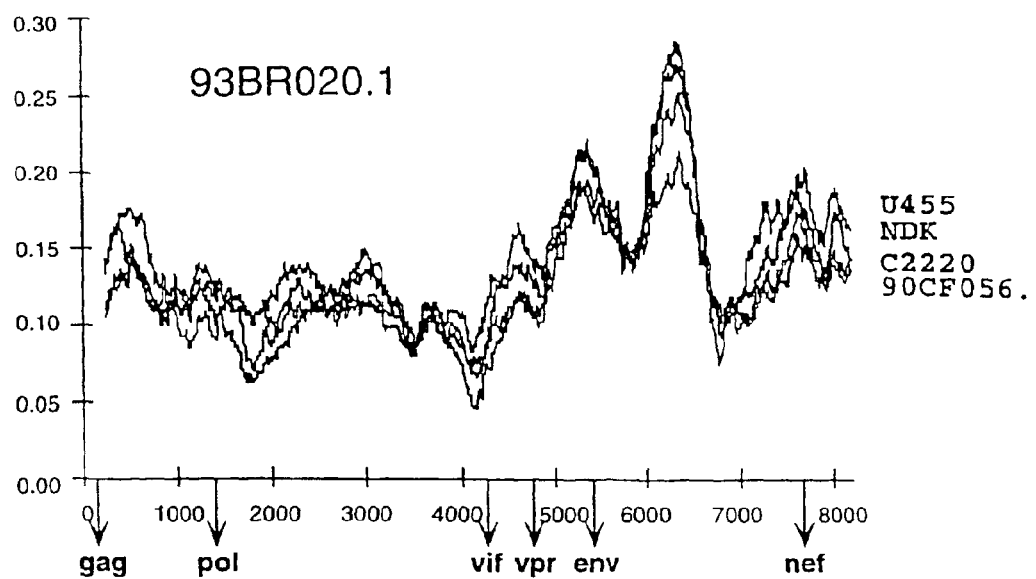
FIGS. 2A–2J. Diversity plots comparing the sequence relationships of the 11 viral genomes described in this patent application to each other and to reference sequences from the database. In each of FIGS. 2A–2J, the sequence named above the plots is compared to the sequences listed at the right. U455, LAI, C2220, and NDK are published reference sequences for subtypes A, B, C and D, respectively. Distance values were calculated for a window of 500 bp moved in steps of 10 nucleotides. The x-axis indicates the nucleotide positions along the alignment (gaps were stripped and removed from the alignment). The positions of the start codons of the gag, pol, vif, vpr, env, and nef genes are shown. The y-axis denotes the distance between the viruses compared (0.05=5% divergence).
Figure 2B:
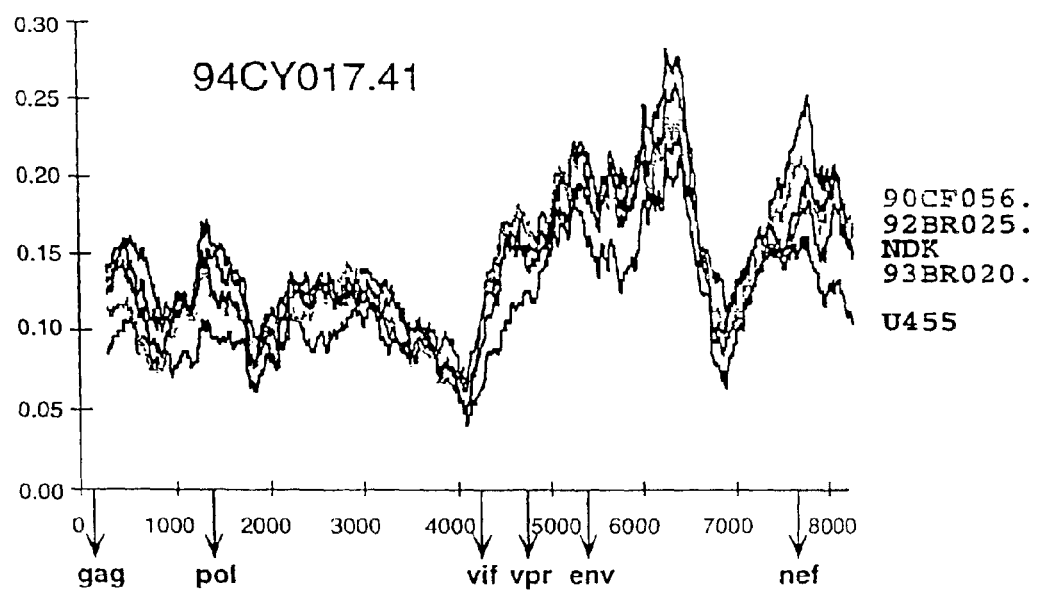
Figure 2C:
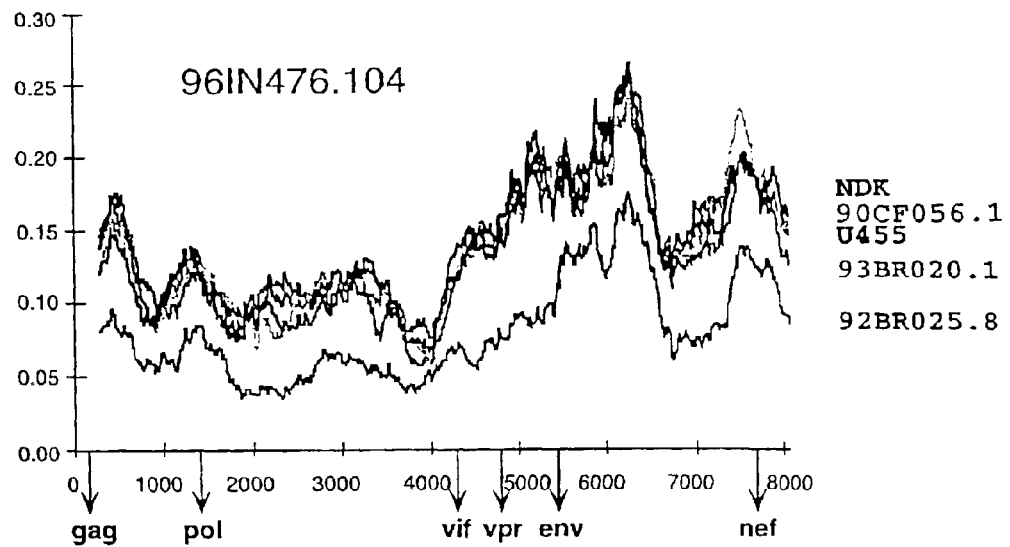
Figure 2D:
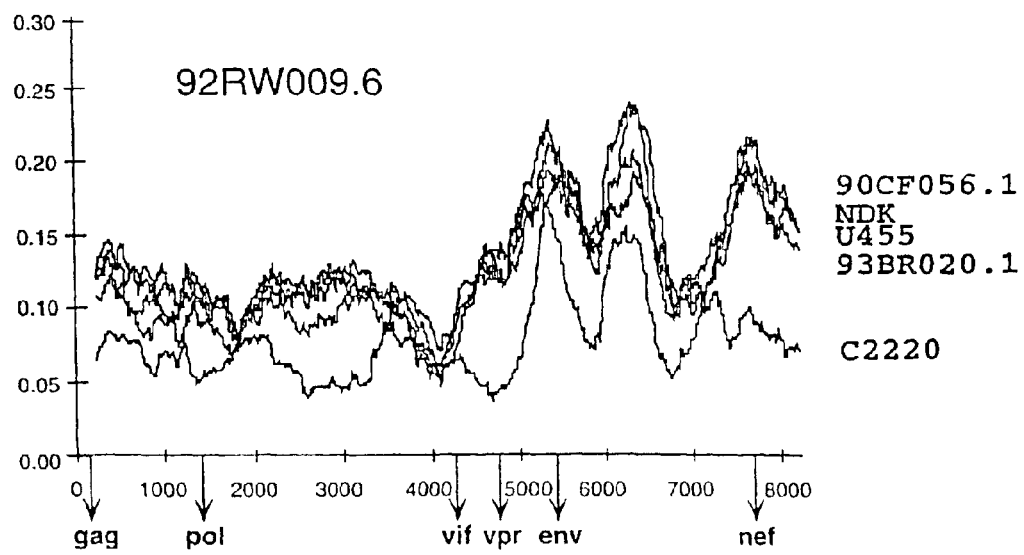
Figure 2E:
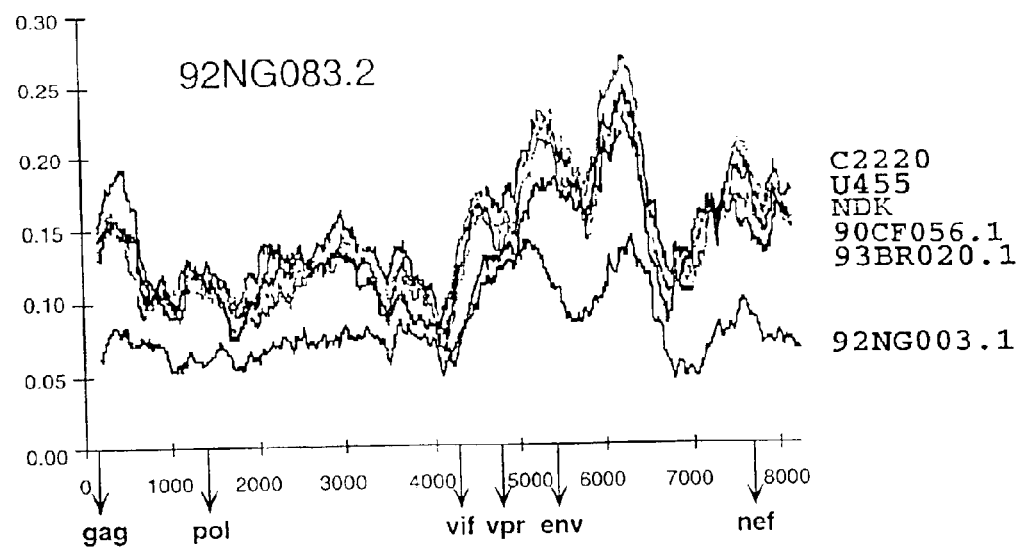
Figure 2F:
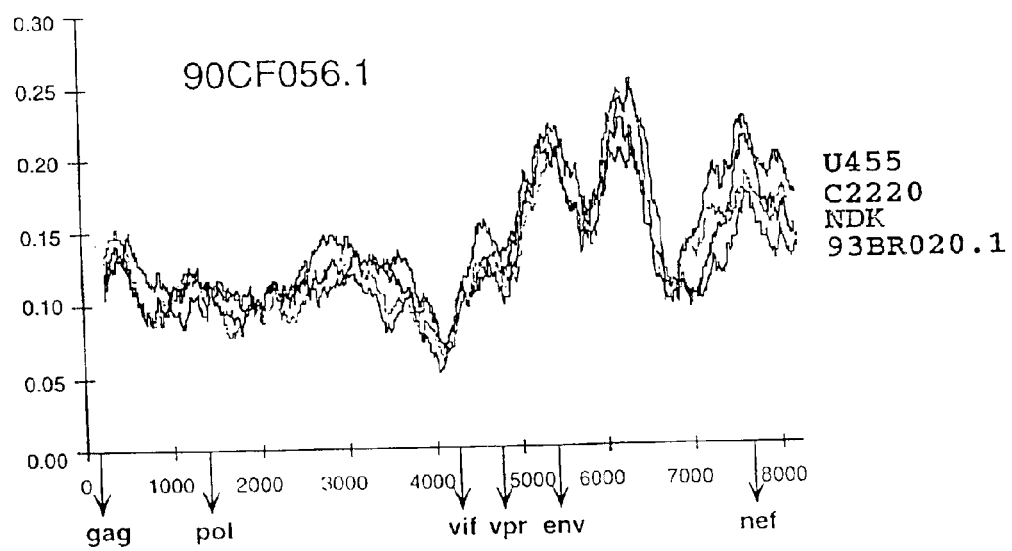
Figure 2G:
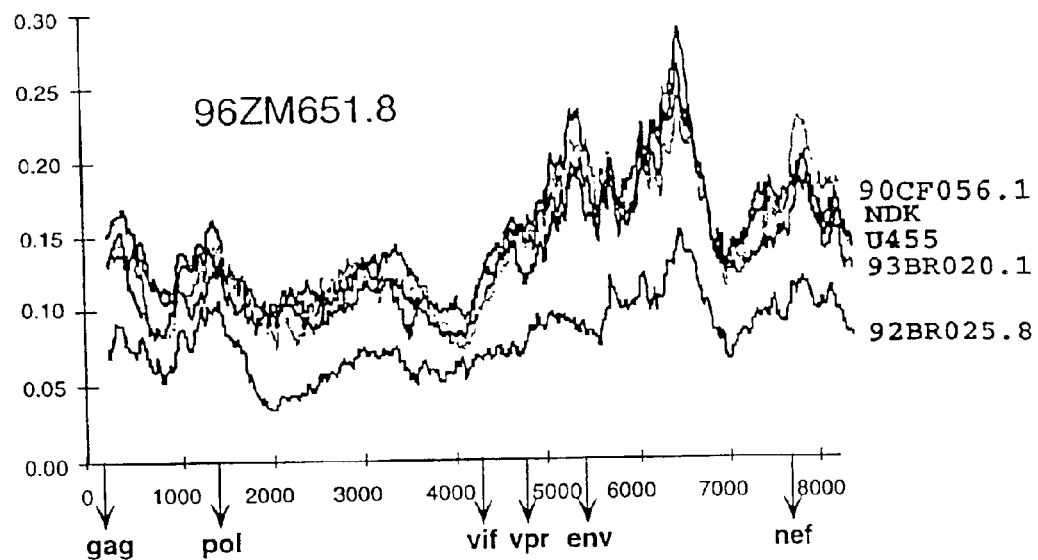
Figure 2H:
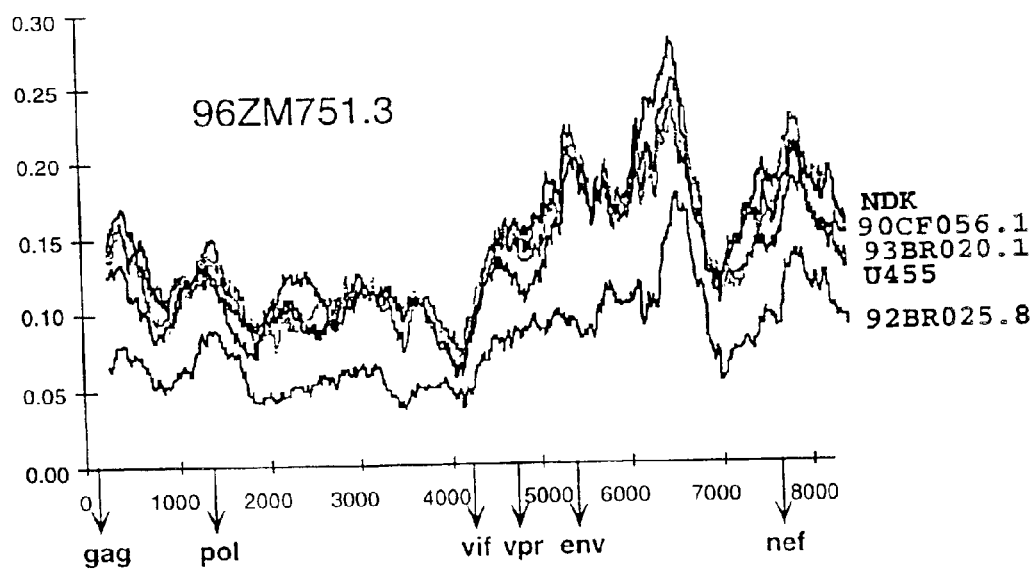
Figure 2I:
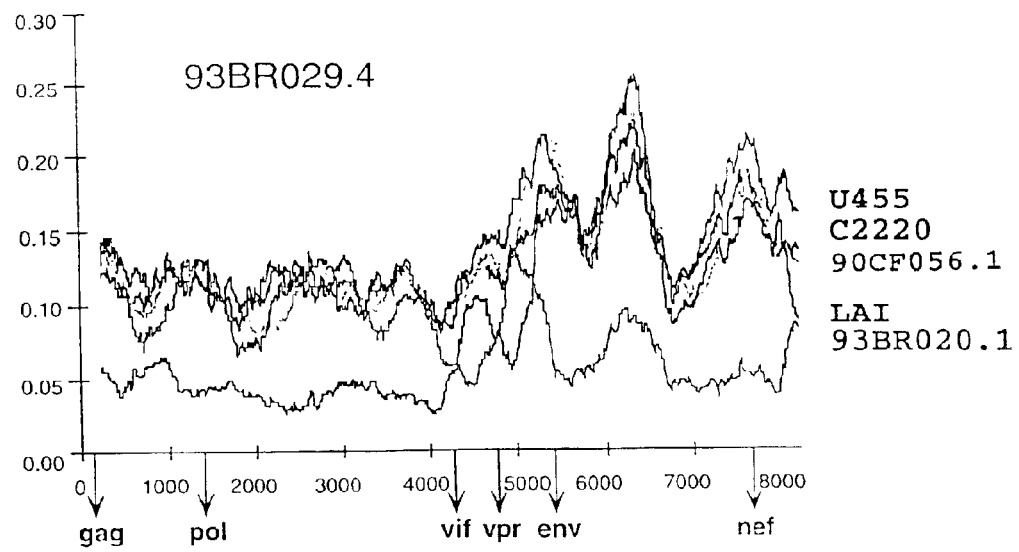
Figure 2J:
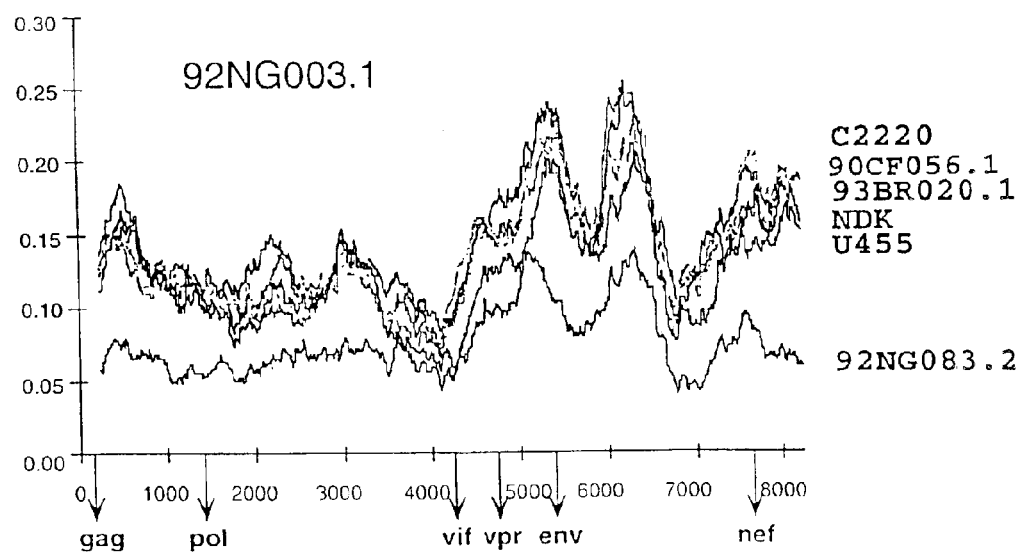
Figure 3A:
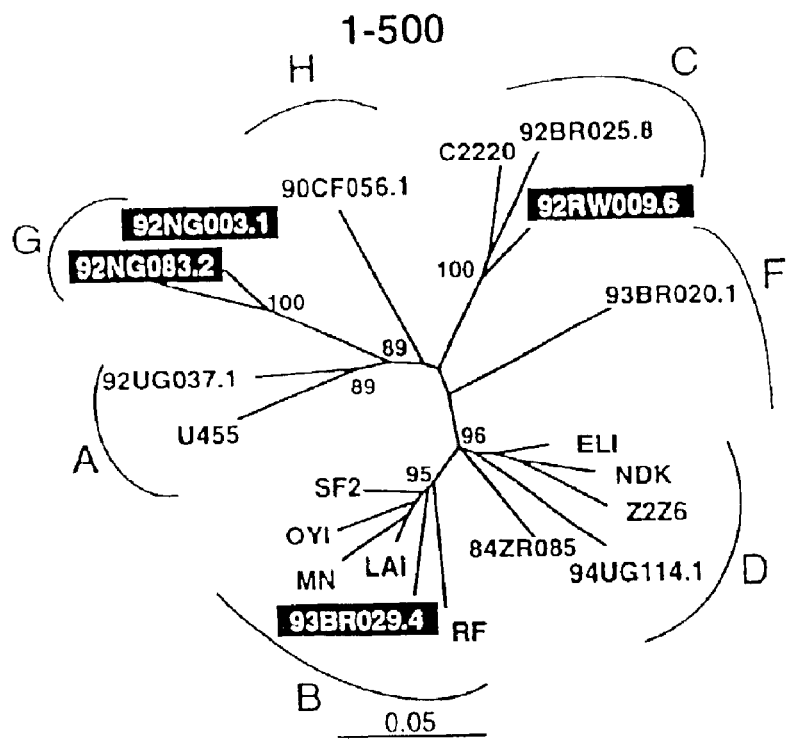
FIGS. 3A–3I. Exploratory tree analysis. Neighbor joining trees were constructed for a 500 bp window moved in increments of 100 bp along the multiple genome alignment. Trees depicting discordant branching orders among four of the 11 sequences included in this patent application are shown in FIGS. 3A–3I (hybrid sequences are boxed). The position of each tree in the alignment is indicated; subtypes are identified by brackets. Numbers at nodes indicate the percentage of bootstrap values with which the adjacent cluster is supported (only values above 80% are shown). Branch lengths are drawn to scale.
Figure 3B:
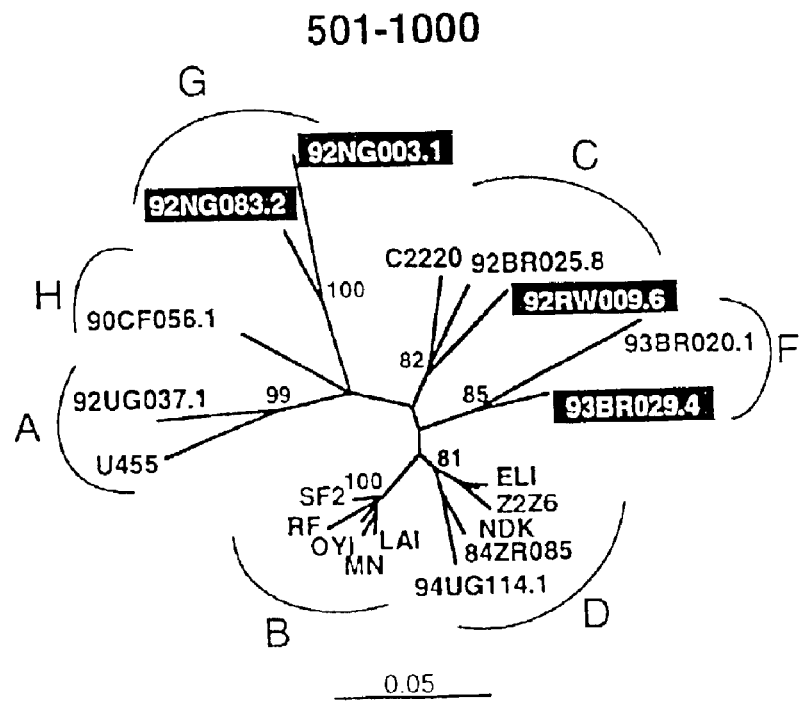
Figure 3C:
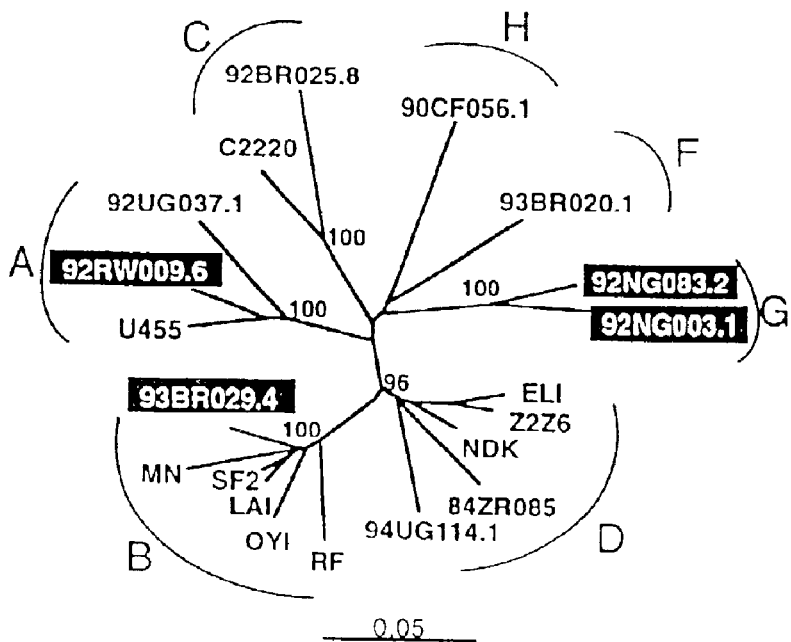
Figure 3D:
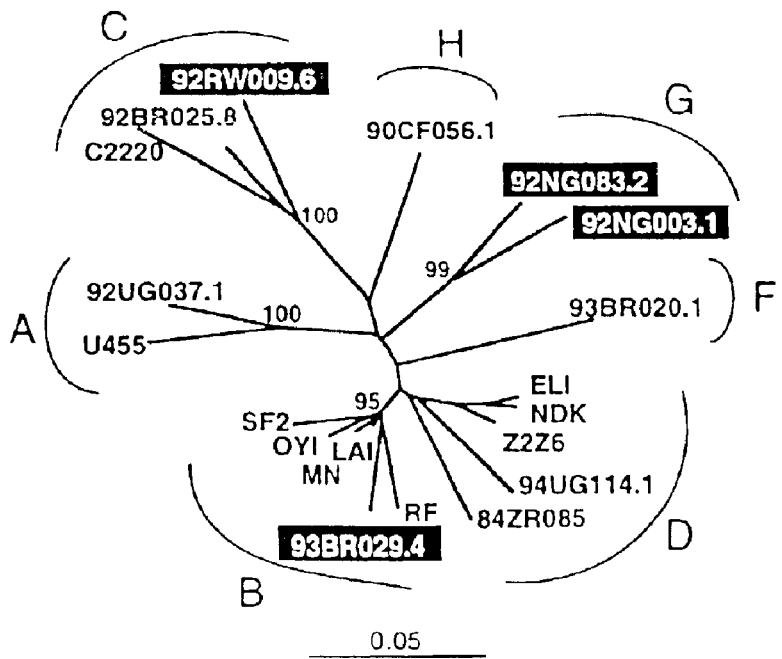
Figure 3E:
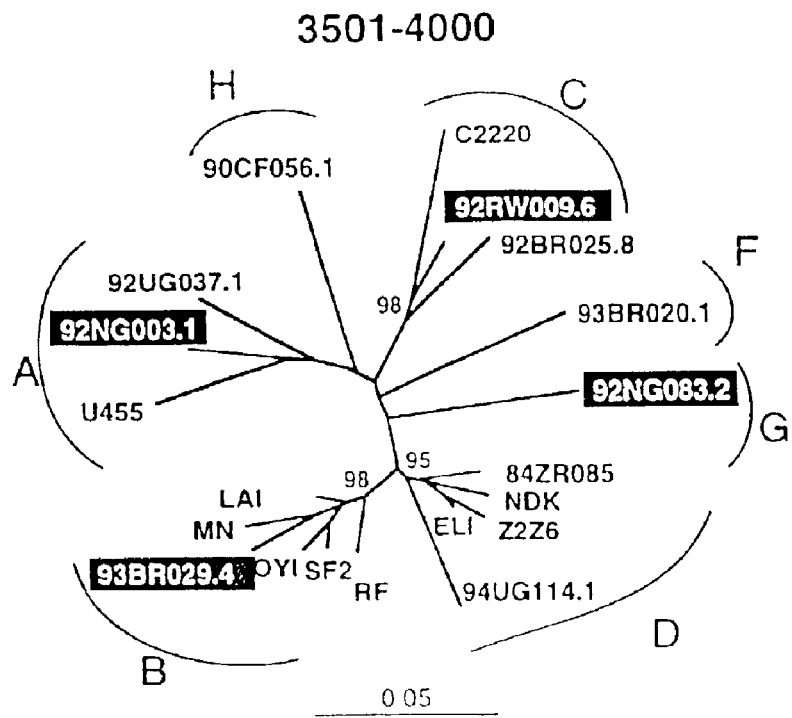
Figure 3F:
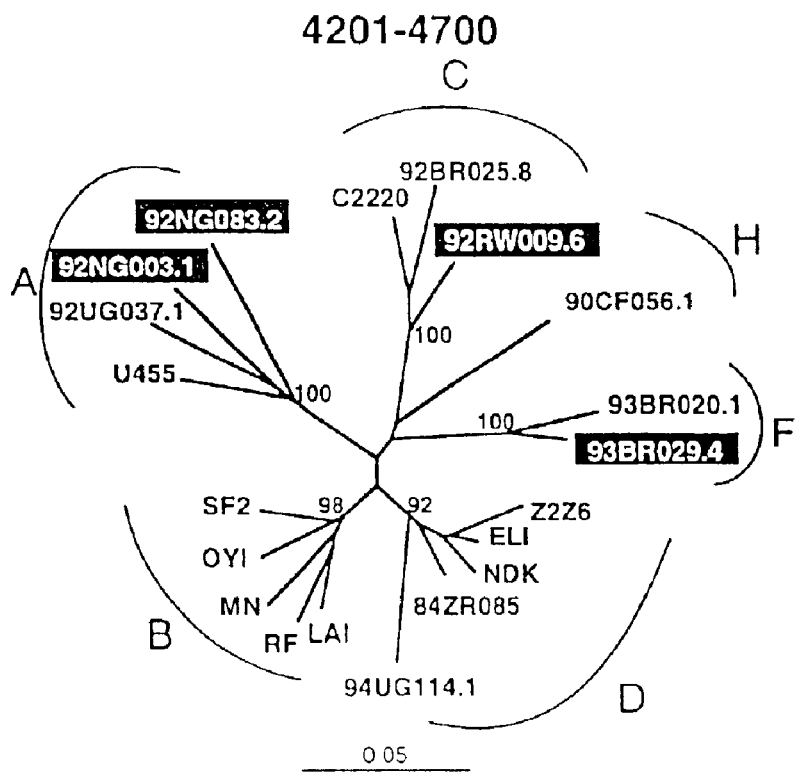
Figure 3G:
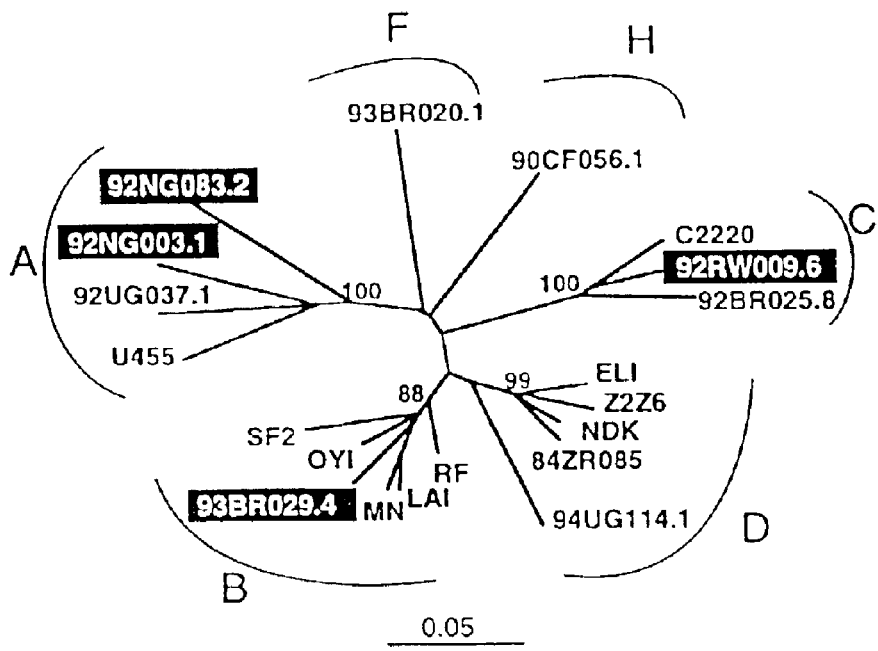
Figure 3H:
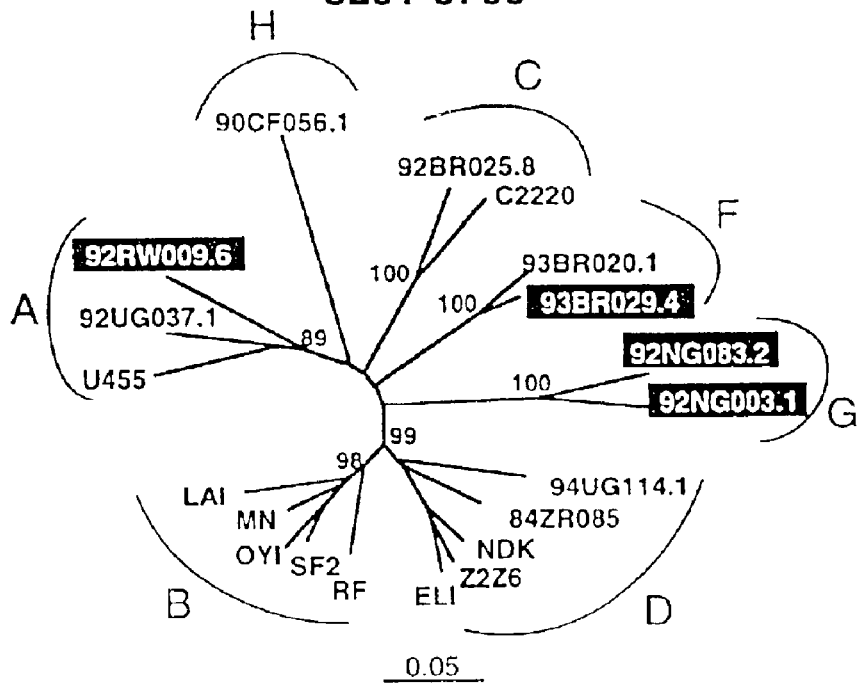
Figure 3L:
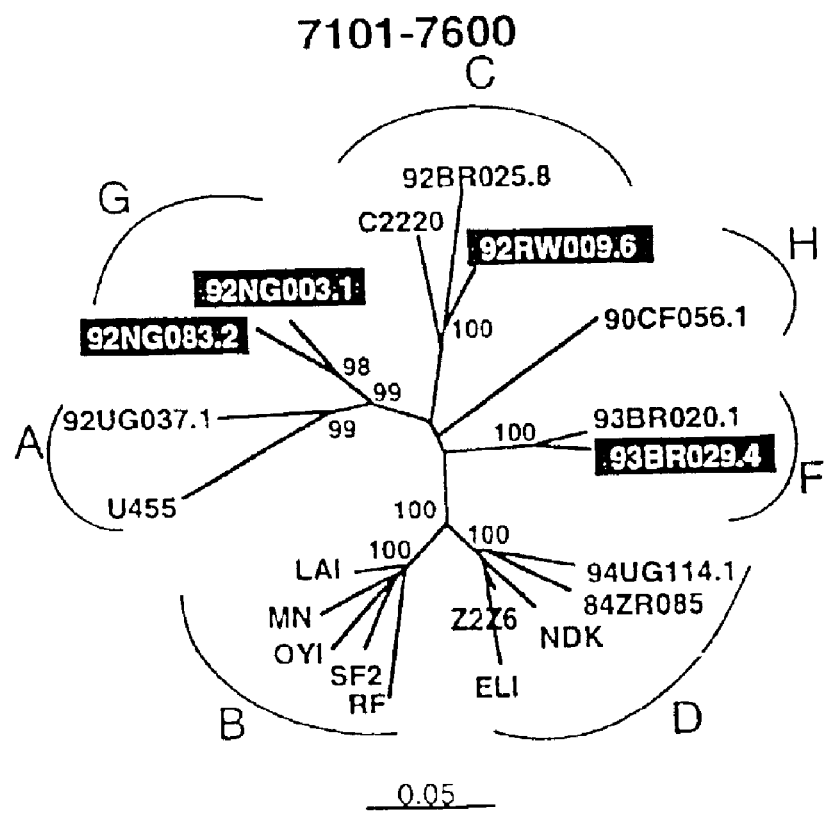

Very similar data were also obtained when 90CF056.1 was subjected to diversity plot analysis using the same set of reference sequences (FIG. 2F). Again, distance curves exhibited very similar profiles indicating approximate equidistance among the strains analyzed, except when viruses from the same subtype were compared. For example, in FIG. 2C distances between 94IN476.104 (putative subtype C) and U455, 93BR020.1, 90CF056.1, NDK and 92BR025.8, respectively, are depicted. As expected, the 92BR025.8 (putative subtype C) plot falls clearly below all others, indicating the lower level of sequence divergence between viruses from the same subtype (ranging from about 4% in pol to about 17% in env). Importantly, however, inter- and intra-diversity plots follow each other very closely, i.e., the same genomic regions exhibit proportionally higher and lower levels of divergence. See also the diversity plot analysis for 92ZM651.8 (FIG. 2G) and 96ZM751.3 (FIG. 2H). Thus, both at the level of inter- and intra-subtype comparisons, there was no evidence of mosaicism in the genomes of these three viruses. Together with the results in FIG. 1, this suggests that strains 94IN476.104, 96ZM651.8 and 96ZM751.3 represent non-mosaic members of subtype C.

By contrast, the diversity plots of the putative recombinants 92RW009.6 (FIG. 2D) and 93BR029.4 (FIG. 2I) exhibited disproportionate levels of sequence divergence from different subtypes along their genome, consistent with their discordant branching orders in gag and env trees. As shown in FIG. 2D, 92RW009.6 is most similar to the subtype C strain C2220 in the 5' half of gag, most of pol, vif, vpr, as well as nef (the C2220 curve falls below all others). However, in the 3' end of gag, the 5' end of pol, and most of env, 92RW009.6 is most similar to the subtype A strain U455 (the U455 curve falls below all others). Similarly in FIG. 2I, 93BR029.4 is most similar to the subtype B strain LAI in gag, pol and vpr, while it is most similar to the putative subtype F strain 93BR020.1 in vif, env and nef regions. In each case, the magnitude of the difference between the new sequence and the most similar subtype was no greater than the diversity seen within subtypes. Thus, these data suggest that 92RW009.6 and 93BR029.1 represent mosaics, comprised of subtypes A/C and B/F, respectively. In each case, the plots suggested several (at least four) cross-overs; these are the minimum number of recombination breakpoints, since the window size used makes it unlikely that recombinant regions shorter than 500 bp would be detected.

Finally, inspection of the diversity plots for 92NG003.1 (FIG. 2J) and 92NG083.2 (FIG. 2E) also revealed disproportionate levels of sequence variation, although not as pronounced as for 92RW009.6 and 93BR029.4. Isolates 92NG003.1 and 92NG083.2 are equidistant from members of subtypes A–F and H for the most part of their genome, suggesting that they represent an independent subtype, i.e., subtype G. However, in the vif/vpr region the U455 distance plot falls below all others, suggesting a disproportionately closer relationship to subtype A. Assuming that U455 is non-mosaic, these results suggest that both 92NG003.1 and 92NG083.2 contain short fragments of subtype A sequence in the central region of their genome.

EXAMPLE 5
Exploratory Tree Analyses

To examine the phylogenetic position of the newly derived strains relative to each other and to the reference sequences over the entire genome, exploratory tree analyses were performed using the same multiple genome alignment generated for the diversity plots (FIGS. 3A–3I). A total of 79 trees were constructed for overlapping fragments of 500 bp, moved in 100 bp increments along the alignment. As expected, four genomes were identified that clustered in different subtypes in different parts of their genome. These included 93BR029.4 which alternated between subtypes F and B, 92RW009.6 which alternated between subtypes A and C, and 92NG083.2 and 92NG003.1 which grouped either independently or within subtype A. Interestingly, the latter two strains exhibited distinct patterns of mosaicism. In trees spanning the region 3501–4000, 92NG003.1 clustered within subtype A, while 92NG083.2 clustered independently, presumably representing subtype G. In contrast to these strains, there was no evidence for a hybrid genome structure in 94IN476.104, 96ZM651.8, 96ZM751.3, 93BR020.1 or 90CF056.1. These viruses branched consistently in all regions analyzed. Based on these findings and the results from the diversity plots, it appeared that five of the eleven selected HIV-1 strains represent non-recombinant reference strains for subtypes C (94IN476.104, 96ZM651.8, 96ZM751.3), F (93BR020.1) and H (90CF056.1), respectively, while at least five are intersubtype recombinants. CY017.41 may be recombinant, but work is in progress in this regard.

EXAMPLE 6

Recombination Breakpoint Analysis

Figure 4A:
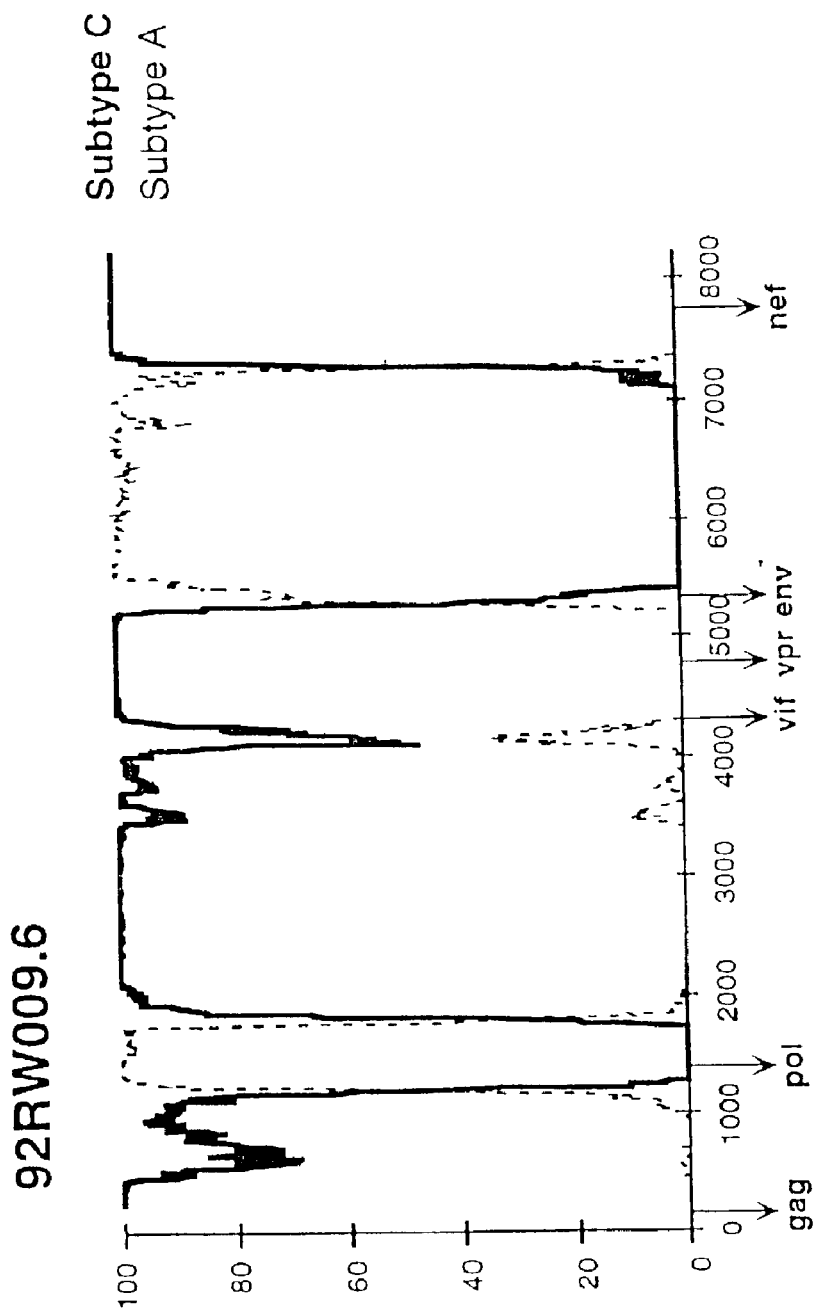
FIGS. 4A–4B. Recombination breakpoint analysis for 92RW009.6 and 93BR029.4.
Figure 4B:
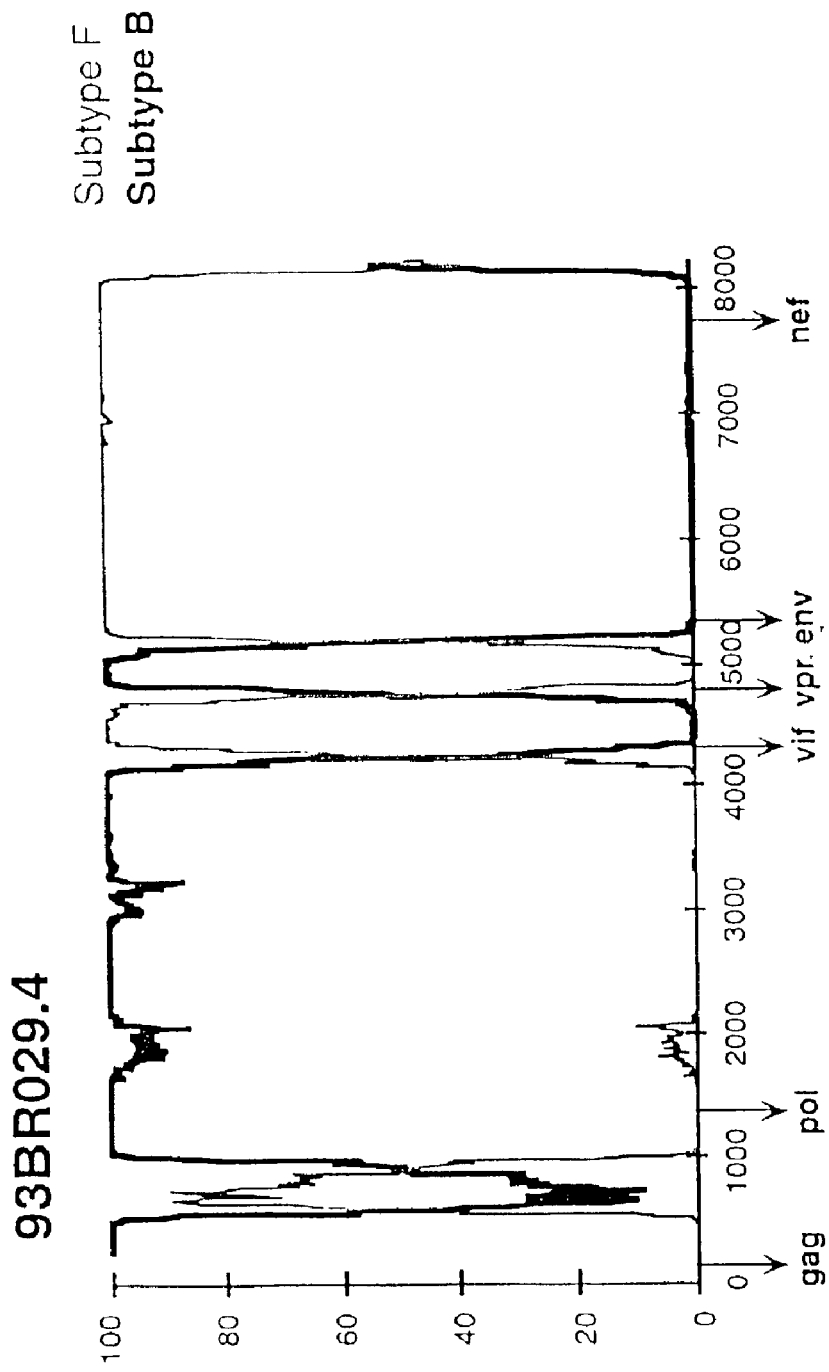

To map the location of the recombination breakpoints in 92RW009.6 and 93BR029.4, bootstrap plots and informative site analyses were used (18,52,53). Unrooted trees were constructed which included U455, 92UG037.1, LAI, MN, OYI, SF2, RF, C2220, 92BR025.1, NDK, ELI, Z2Z6, 93BR020.1 and 90CF056.1; then the magnitude of the bootstrap values supporting (i) the clustering of 92RW009.6 with members of subtype A (U455, 92UG037.1) or C (2220, 92BR025.8), as well as (ii) the clustering of 93BR029.4 with members of subtype B (LAI, MN, OYI, MN, RF) or F (92BR020.1) was determined (in the latter case subtype D viruses were excluded because of their known close relationship to subtype B viruses). FIGS. 4A–4B depict the results of 797 such phylogenetic analyses generated for each genome, performed on a window of 500 nucleotides moved in steps of 10 nucleotides. Very high bootstrap values (>80%) supporting the clustering of 92RW009.6 with subtype C were apparent in gag, the 3' two-thirds of pol, and nef. By contrast, significant branching of 92RW009.6 with subtype A was apparent in the gag/pol overlap and the env region. In a small region (4,000 to 4,200) in the middle of the genome, 92RW009.6 appeared not to cluster significantly with either subtype, but further inspection revealed that this was due to a small number of informative sites. These data thus indicated four points of recombination crossovers between subtypes A and C (FIG. 4A). A similar analysis identified six recombination breakpoints between subtypes B and F in 93BR029.4 (FIG. 4B). These included two more (in gag) than were apparent from the diversity plot analysis (compare FIGS. 2A–2J), indicating a greater sensitivity of this approach.

Figure 6:
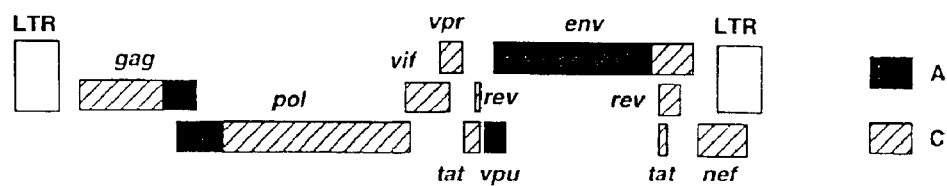
FIG. 6. Inferred structure of the five recombinant genomes included in this patent application. LTR sequences were not analyzed and are thus shown as open boxes.
Figure 6:
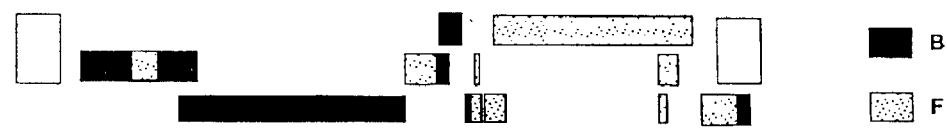
Figure 6:
Figure 6:
Figure 6:

To map the recombination cross-over points in 92RW009.6 and 93BR029.1 more precisely, the distribution of phylogenetically informative sites supporting alternative tree topologies were examined (52,53). Briefly, this was done in a four sequence alignment which included the query sequence, a representative of each of the two subtypes presumed to have been involved in the recombination event, and an outgroup. Breakpoints were identified by looking for statistically significant differences in the ratios of sites supporting one topology versus another. Consistent with the bootscanning data, this analysis identified four breakpoints in 92RW009.6, and six in 93BR029.4 (Table 3). A schematic representation of the mosaic genomes of 92RW009.6 and 93BR029.4 is depicted in FIG. 6.

TABLE 3

Informative site analysis of 92RW009.6 and 93BR029.4

| Clone | Region[#] | Subtype | Informative Sites subtype A (U455) | Informative Sites subtype C (C2220) | Informative Sites outgroup (NDK) |
|---|---|---|---|---|---|
| 92RW009.6 | 1–1037 | C | 8 | 32 | 8 |
|  | 1085–1940 | A | 17 | 5 | 4 |
|  | 1986–5288 | C | 18 | 99 | 27 |
|  | 5293–7238 | A | 60 | 9 | 13 |
|  | 7254–8431 | C | 12 | 55 | 12 |

| Clone | Region[#] | Subtype | subtype B (LAI) | subtype F (93BR020) | outgroup (C2220) |
|---|---|---|---|---|---|
| 93BR029.4 | 1–735 | B | 18 | 6 | 3 |
|  | 755–896 | F | 1 | 10 | 0 |
|  | 930–4247 | B | 99 | 10 | 14 |
|  | 4340–4668 | F | 2 | 15 | 1 |
|  | 4787–5166 | B | 15 | 0 | 5 |
|  | 5244–8242 | F | 15 | 139 | 13 |
|  | 8250–8429 | B | 13 | 0 | 0 |

[#]Numbers mark positions in the four sequence alignment which includes the untranslated leader sequence (1–120), gag (121–1537), pol (1370–4340), vif (4285–4856), vpr (4799–5073), the first tat exon (5054–5271), vpu (5276–5488), env (5406–7726), nef (7727–8313) and the 3' LTR (7991–8468). Note that position 8468 does not correspond to the end of the LTR but is the last position in the alignment after gaps have been tossed. The 5' LTR is not included in the alignment.

Because of the lack of a full length subtype G reference sequence, recombination breakpoint analysis of 92NG003.1 and 92NG083.2 required a different approach. The analyses summarized in FIGS. 2A–2J and FIGS. 3A–3I suggested that these two viruses contained subtype A sequences in the middle of their genome. To attempt to confirm this, and to define the extent of these putative subtype A fragments, a more detailed diversity plot analysis of the viral middle region (between position 3,000 and 6,000) was performed using different viral strains and varying window sizes (ranging from 200 to 400 bp) to examine the extent of sequence divergence of 92NG083.2 and 92NG003.1 from members of other subtypes, including subtype A. Diversity plots for 92NG003.1 compared to U455, C2220, NDK and 92NG083.2 and for 92NG083.2 compared to U455, C2220, NDK and 92NG003.1 depicted representative results (using a window size of 300 bp moved in steps of 10 bp along the alignment) (data not shown). Similar to the data shown in FIGS. 2A–2J, the two "subtype G" viruses are roughly equidistantly related to members of subtypes A (U455), C (C2220), and D (NDK), except for two regions in 92NG003.1 and one region in 92NG083.2 where both viruses are disproportionately more closely related to U455 than they are to each other. Noting the points at which the "G"-A distance increases or decreases relative to the others allowed the tentative identification of recombination breakpoints. For example, at position 3400, the U455 plot falls whereas the C2220, NDK and 92NG083.2 plots do not, and around site 3600 the U455 plot crosses the 92NG083.2 plot. Bearing in mind the window size of 300 nucleotides, this finding suggested that a recombination cross-over occurred around position 3500. Similar "G"-A plot crossings around positions 3800, 4200 and 5200 (in the diversity plot for 92NG003.1), and around positions 4200 and 4800 (in the diversity plot for 92NG083.2), suggested additional recombination breakpoints.

Figure 5B:
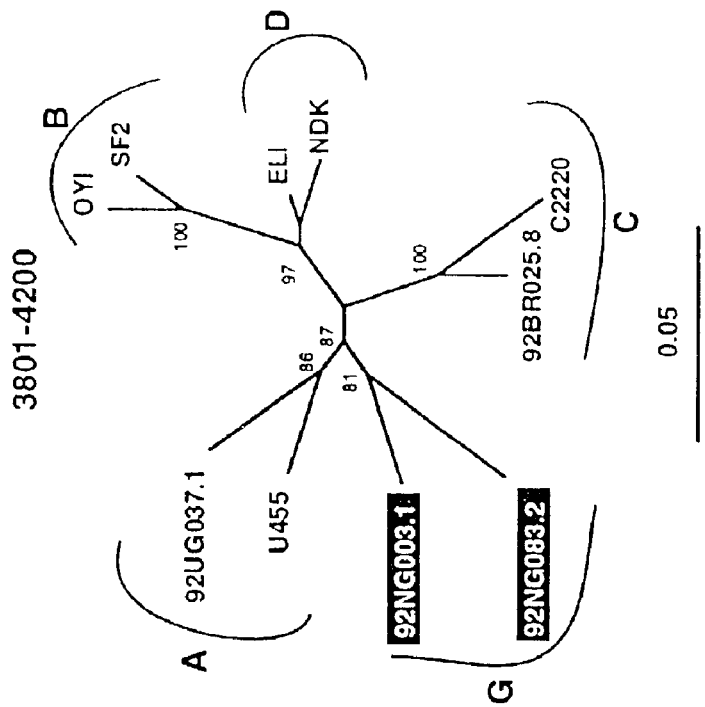
FIGS. 5A–5D. Recombination breakpoint analysis of 92NG083.2 and 92NG003.1. Neighbor joining trees depicting discordant branching orders of 92NG003.1 and 92NG083.2 in regions delineated by breakpoints identified by distance plots (not shown) are shown in FIGS. 5A–5D (hybrid sequences are boxed). The position of each tree in the alignment is indicated; subtypes are identified by brackets. Numbers at nodes indicate the percentage of bootstrap values with which the adjacent cluster is supported (only values above 80% are shown). Branch lengths are drawn to scale.
Figure 5A:
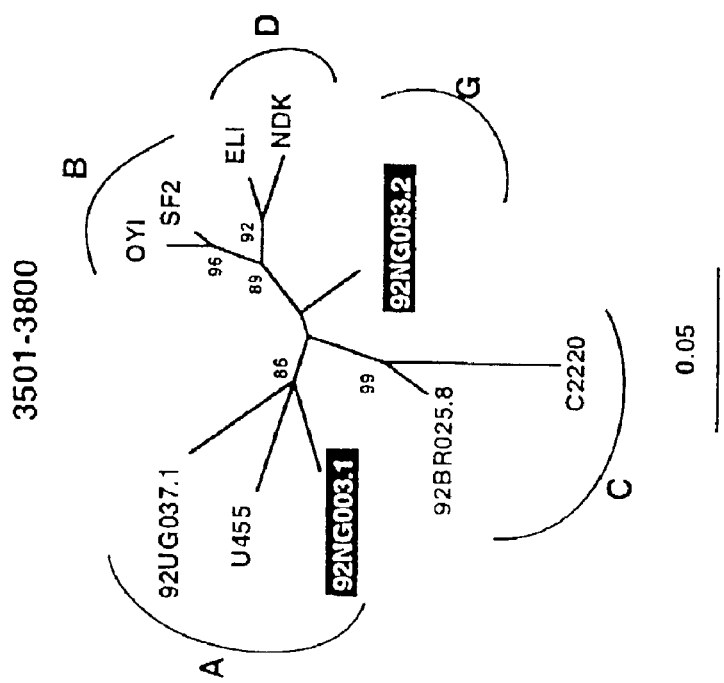
Figure 5D:
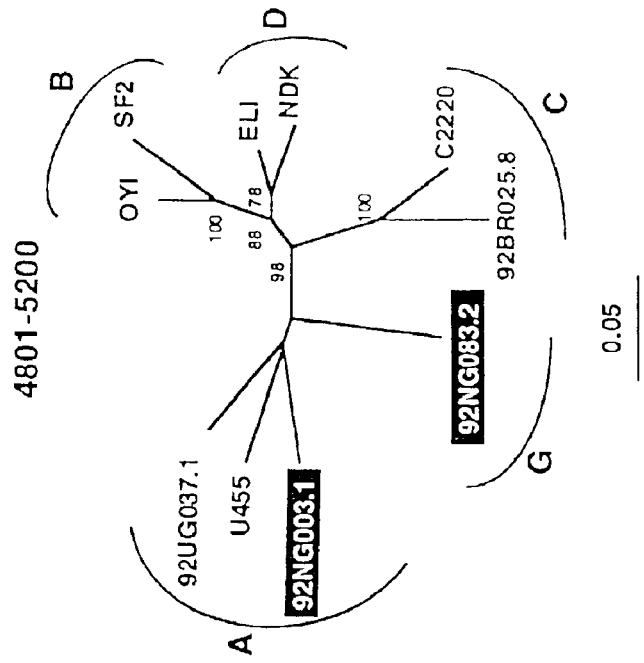
Figure 5C:
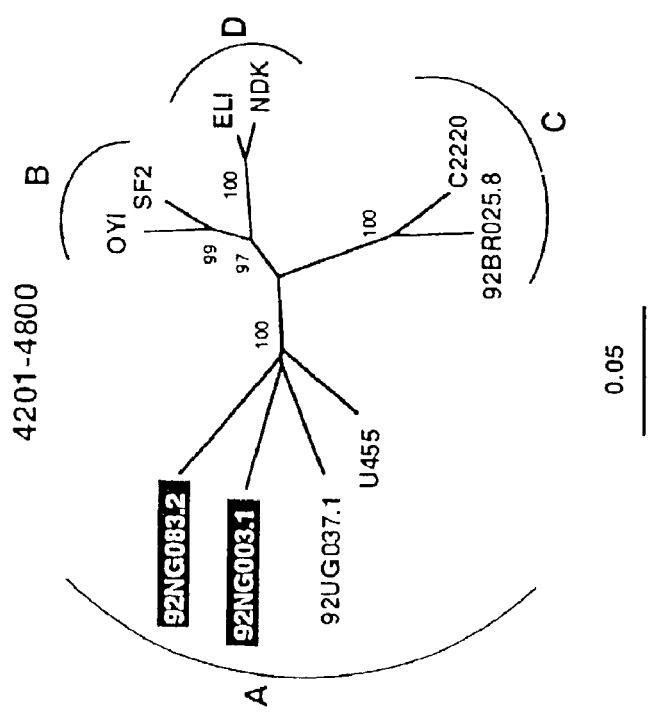

Phylogenetic trees were then constructed using the regions of sequence defined by these putative breakpoints (FIGS. 5A–5C). This analysis generally supported the conclusions drawn from the diversity plots, i.e., 92NG003.1 clustered with subtype A viruses in the region between 3501 and 3800, whereas 92NG083.2 did not; and both 92NG003.1 and 92NG083.2 clustered with subtype A viruses in the region 4201 and 4800. However, neither the diversity plot nor the tree analysis allowed the definition of the boundaries of the subtype A fragments with certainty. Nevertheless, the data indicated that (i) both 92NG083.2 and 92NG003.1 represent G/A recombinants, (ii) that they are the result of different recombination events because some of their breakpoints are clearly different, and (iii) that 92NG083.2 likely encodes a non-recombinant pol gene. A schematic representation of the mosaic genomes of 92NG083.2 and 92NG003.1 is shown in FIG. 6.

EXAMPLE 7

Subtype Specific Genome Features

Figure 7B:
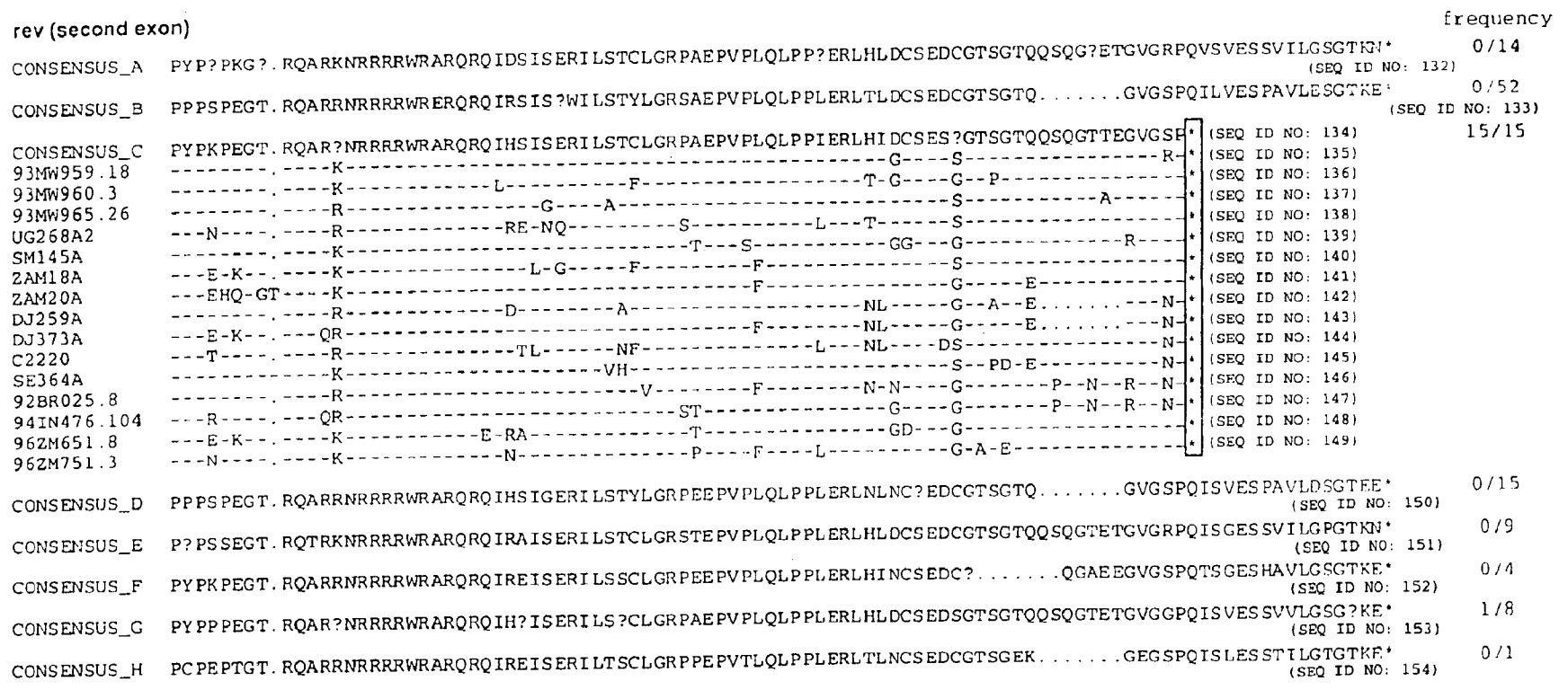

Having classified the new viruses with respect to their subtype assignments, their sequences were examined for clade-specific signature sequences. Comparing deduced amino acid sequences gene by gene, several subtype specific features were found (FIGS. 7A–7C). For example, most subtype D viruses contain an in-frame stop codon in the second exon of tat, which removes 13 to 16 amino acids from the carboxy terminus of the Tat protein (FIG. 7A). Similarly, all subtype C viruses (including 94IN476.104, 96ZM651.8 and 96ZM751.3) contain a stop codon in the second exon of rev which would be predicted to shorten this protein by 16 amino acids (FIG. 7B). Subtype C viruses also contain a 15 base pair insertion at the 5' end of the vpu gene (FIG. 7C) which extends the putative membrane spanning domain of the Vpu protein by 5 amino acids (data not shown). Although these changes are unlikely to alter the function of the respective gene products in a major way (e.g., the known functional domains of both Tat and Rev proteins are not affected by these changes), it is possible that they could influence their mechanism of action in a subtle (but nevertheless biologically important) manner.

Figure 8:
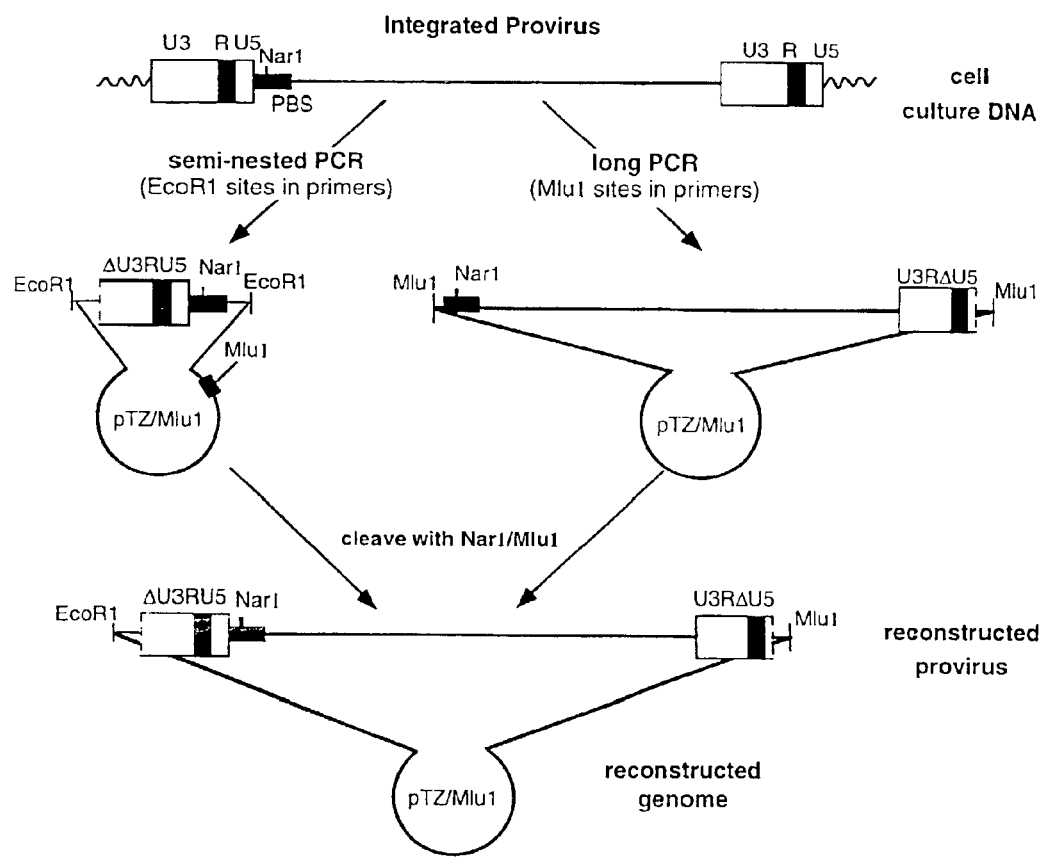
FIG. 8. Generation of replication competent proviral clones from long PCR products. The general construction scheme of a replication competent provirus from two separately amplified genomic regions is depicted.

Of the eleven non-subtype B clones identified herein, phylogenetic analysis identifies five of these viruses as non-recombinant members of subtypes C (three), F and H, which increases the number of non-subtype B reference strains available. Among these, the (near) full length genomes of 93BR020.1 and 90CF056.1 represent the first such strains for subtypes F and H, respectively. Five of the other viruses were found to represent complex mosaics of subtypes A and C, A and G (two), B and F and A, G and I. One, 94CY017.41, is not yet fully characterized. Both A/G recombinants originated from Nigeria, but must have arisen from independent recombination events since they are not closely related and differ in their patterns of mosaicism. One of these (92NG083.2) appears to contain only a single short (perhaps 600 bp) segment of subtype A origin in the vif/vpr region, and in the absence of (as yet) any full length subtype G virus, thus serves as a (non-mosaic) subtype G representative for gag, pol, env, and nef regions. Importantly, the genomes were generated in such a way that they can be tested for biological activity following a simple reconstruction step. An example of such a reconstructed genome giving rise to replication competent virus (94UG114.1) demonstrates that this approach is feasible. See "Materials and Methods," supra, and the schematic diagram in FIG. 8.

Given the apparent prevalence of mosaic viruses, it is clear that subtype specific reference strains can only be defined as such after comprehensive recombination analysis. Small subgenomic fragments or even full length gag and env sequences are not sufficient to identify all hybrid genomes. Although multiple cross-overs are a characteristic feature of retroviral recombination and have been found in many of the mosaic HIV-1 genomes examined (7,19,53,60,62), the examples of 92NG003.1 and 92NG083.2 demonstrate that cross-overs may be confined to regions outside of gag and env. Thus, elimination of the possibility that a virus is recombinant requires the determination of substantial (if not all) portions of its genome. As a consequence, subtype specific reference reagents, such as immunogens for cross-clade CTL and neutralization assays, should be derived from viral isolates for which a complete genome has been characterized.

These considerations emphasize the need for detailed analyses using reliable methods for identification of recombinant viral sequences. The above results indicate that diversity plots, depicting the distance between the query sequence and a set of reference sequences in moving windows along the genome, represent an excellent initial screening tool. The extent of sequence divergence (between any pair of viruses) varies along the genome, but since all plots are shown in the same graph, particular regions where the query sequence is anomalously highly similar to (or divergent from) other sequences can be readily identified. For example, this approach uncovered the subtype A-like regions in the middle of the putative "subtype G" genomes 92NG003.1 and 92NG083.2 (FIGS. 2J and 2E; FIGS. 5A–5C). However, the results from such analyses relying only on extents of sequence divergence must be treated with some caution, because they are susceptible to variation in evolutionary rate in different lineages. Once suspicious regions have been identified, phylogenetic analyses of windows of sequence around these regions can be used to look for discordant branching orders, and to identify the subtypes likely to have been involved in the recombination event. The bootstrap value supporting the clustering of the query sequence with sequences of the supposed "parental" subtypes can be examined, again in moving windows along the genome. Finally, informative site analysis can be used to map as precisely as possible the breakpoints of the putative recombination events (52,53).

Clearly, recombination analysis relies on the availability of accurately defined non-mosaic reference sequences. Thus, location of the breakpoints in the two G/A recombinant viruses identified here must remain tentative because of the lack of such reference sequences for subtype G. The precise positions of breakpoints in the recently characterized Thai and CAR "subtype E" viruses are similarly uncertain (7,18), in this case for lack of a complete non-mosaic subtype E reference sequence. It should also be emphasized that currently designated reference sequences may require revision in the future. For example, the inadvertent inclusion of recombinant "reference" sequences in previous tree analyses (19,40) led to an incorrect subtype assignment of subtype G and "E" gp41 sequences. As more sequences become available, it is thus possible that one or more of the viral sequences currently designated as non-recombinant may be identified as a hybrid.

EXAMPLE 8

Identification of the HIV-1 Clone 94CY032.3

Full length reference clones and sequences are currently available for eight HIV-1 group M subtypes (A–H), but none have been reported for subtypes I and J, which have only been identified in a handful of individuals. Phylogenetic information for subtype I, in particular, is limited since only a very small env gene fragment (400 bp in the C2-V3 region) obtained from only two individuals (a heterosexual couple of intravenous drug users from Cyprus) has been analyzed. To characterize subtype I in greater detail, long range PCR was employed to clone a full length provirus (94CY032.3) from a short-term cultured isolate (94CY032) established from one of the two individuals originally reported to be infected with this subtype.

Using primers homologous to the tRNA primer binding site (5'-TCTCT-acgcgtGGCGCCCGAACAGGGAC-3' (SEQ ID NO: 111), lower case letters indicate an Mlu1 site) and the polyadenylation signal in the 3' LTR (5'-ACCAGacgcgtACAACAGACGGG-CACACACTACTT-3') (SEQ ID NO: 112), long range PCR was used to amplify near full length genomic fragments, which contained all coding and regulatory regions except for 102 bp of 5' unique LTR sequences (U5) (for methodological details concerning the long range PCR approach see refs. 18, 56, 79). Amplification products were subcloned into an a plasmid vector, mapped by restriction enzyme digestion, and one clone (94CY032.3) was selected for further analysis. A 694 bp fragment spanning the remainder of the LTR was amplified separately using a semi-nested approach (18).

The complete sequence of 94CY032.3 was determined using the primer walking approach [GenBank accession numbers: AF049337 (genome) and AF049338 (LTR)]. Examination of potential coding regions revealed the expected reading frames for gag, pol, vif, vpr, tat, rev, vpu, env and nef (FIGS. 13A–13Z). None of the genes contained major deletions, insertions or rearrangements. However, both env and vif genes contained single in-frame stop codons (FIGS. 13A–13Z). There was also a frameshift at position 5199 (single base pair insertion) which altered the C-terminus (last six amino acid residues) of the Vpr protein. All other protein domains of known function as well as major regulatory sequences, including the primer binding site, the packaging signal and major splice sites, appeared to be intact. Similarly, the number, position and consensus sequences of promoter and enhancer elements in the 94CY032.3 LTR were indistinguishable from those of most other HIV-1 strains, except for the presence of an unusual TATA sequence (TAAAA), thus far only found in "subtype E" (A/E) viruses from Thailand and the Central African Republic (7, 18).

To compare 94CY032.3 to previously reported subtype I sequences, a phylogenetic tree was constructed from C2-V3 sequences, including representatives of all 10 known group M subtypes (data not shown). As expected, 94CY032.3 clustered most closely with CYHO321 and CYHO322, sequences amplified from uncultured PBMC DNA of the same individual (HO32) from whom the 94CY032 isolate was derived. 94CY032.3 also clustered very closely with CYHO311, a sequence derived from the sexual partner of HO32 (29), strongly suggesting that the two infections were epidemiologically linked. Finally, as observed in the past (29), all subtype I sequences clustered independently, forming a distinct lineage roughly equidistant from all other subtypes, including subtype J (30). These findings thus confirmed the authenticity of the 94CY032.3 clone and validated it as a representative of subtype I in the C2-V3 region of the viral envelope.

To characterize the remainder of the 94CY032.3 genome, pairwise sequence comparisons were then performed with recently reported non-mosaic reference sequences for subtypes A–H (32, 79) as well as selected intersubtype recombinants (83). This approach has been useful for identifying regions of unusual sequence similarity (or dissimilarity) as an indicator of recombination (18, 79). Briefly, 94CY032.3 was added (using the profile alignment option of CLUSTAL W; 27) to a multiple genome alignment which included a total of 28 sequences from the database (81) representing subtypes A (U455, 92UG037.1), B (LAI, RF, OYI, MN and SF2), C (C2220, 92BR025.8), D (NDK, Z2Z3, ELI, 84ZR085.1, 94UG114.1), F (93BR020.1), and H (90CF056.1) as well as A/C (ZAM184, 92RW009.6), A/G (92NG083.2, 92NG003.1, Z321, IBNG), A/D (MAL), and A/E (93TH253.3, CM240, 90CF402.1) and B/F (93BR029.4) recombinants (SIVcpzGAB was included as an outgroup). All sites with a gap in any of the sequences were removed from the alignment to ensure that all comparisons were made across the same sites. The percent nucleotide sequence diversity between 94CY032.3 and selected other viruses was then calculated for sequence pairs by moving a window of 400 bp in steps of 10 bp along the genome.

Figure 9:
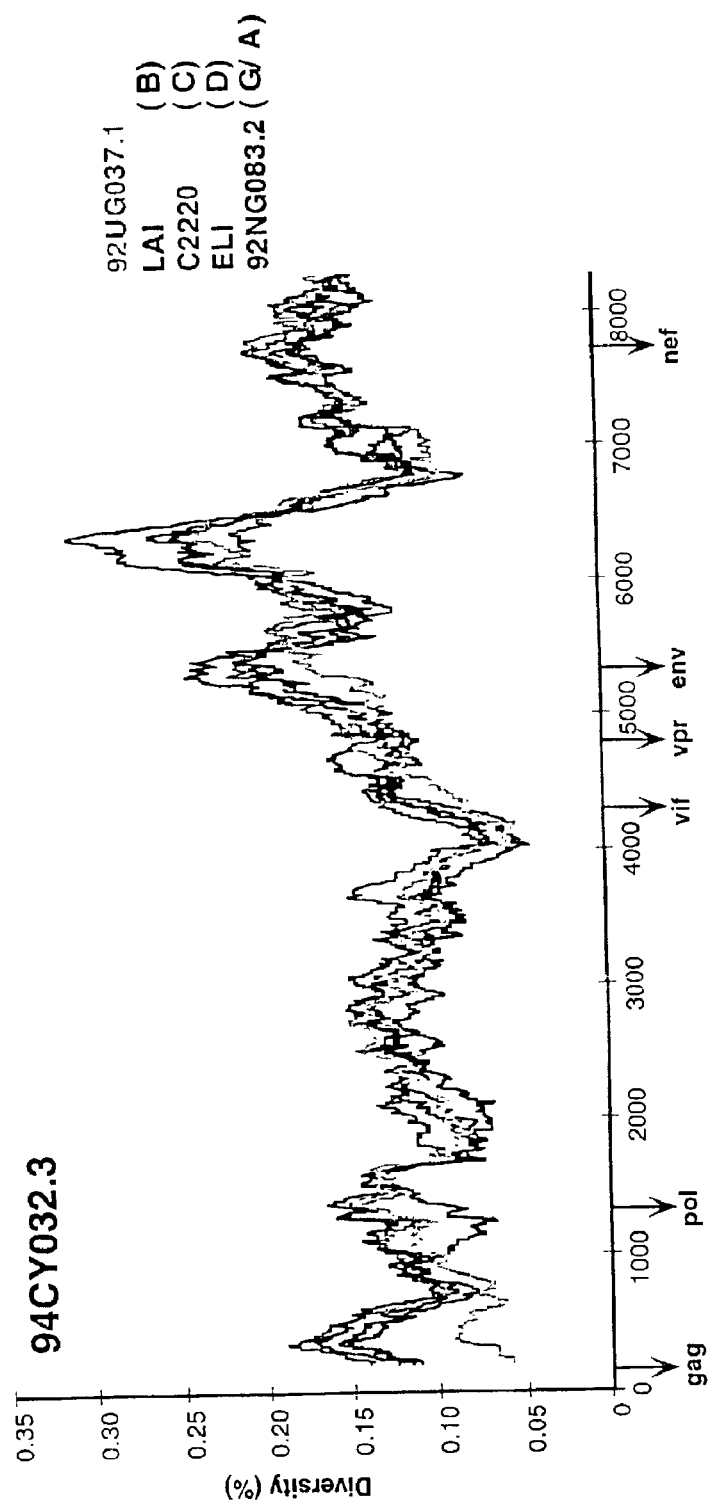
FIG. 9. Diversity plots comparing the sequence relationships of 94CY032.3 to reference sequences from the database. 92UG037.1, LAI, C2220, and ELI are reference sequences for subtypes A, B, C and D, respectively. 92NG083.2 is a known G/A recombinant, but contains only a small subtype A fragment between position 4200 and 4800 (there is presently no full length non-mosaic subtype G reference sequence available). Distance values were calculated for a window of 400 bp moved in steps of 10 nucleotides. The x-axis indicates the nucleotide positions along the alignment (gaps were stripped and removed from the alignment). The positions of the start codons of the gag, pol, vif, vpr, env, and nef genes are shown. The y-axis denotes the distance between the viruses compared (0.05= 5% difference).
Figure 10A:
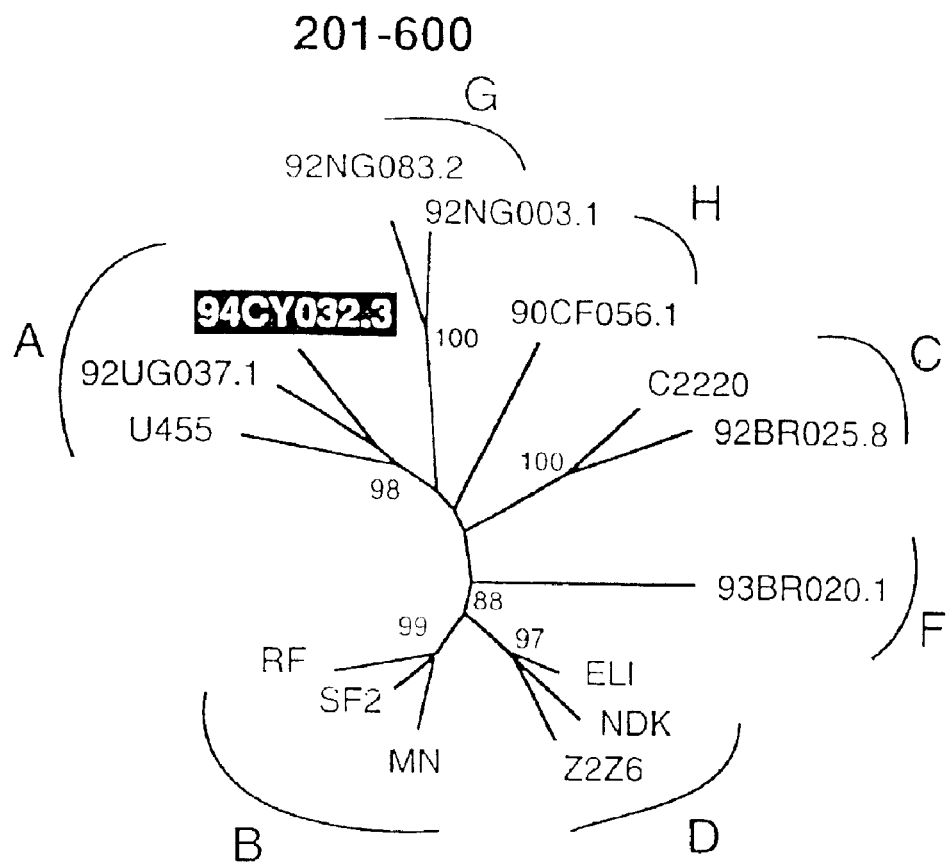
FIGS. 10A–10K. Exploratory tree analysis. Neighbor joining trees were constructed for a 400 bp window moved in increments of 10 bp along the multiple genome alignment. Trees in FIGS. 10A–10K depict the discordant branching orders for 94CY032.3 (highlighted). The position of each tree in the alignment is indicated; subtypes are identified by brackets. Numbers at nodes indicate the percentage of bootstrap values with which the adjacent cluster is supported (only values above 80% are shown). Branch lengths are drawn to scale.
Figure 10B:
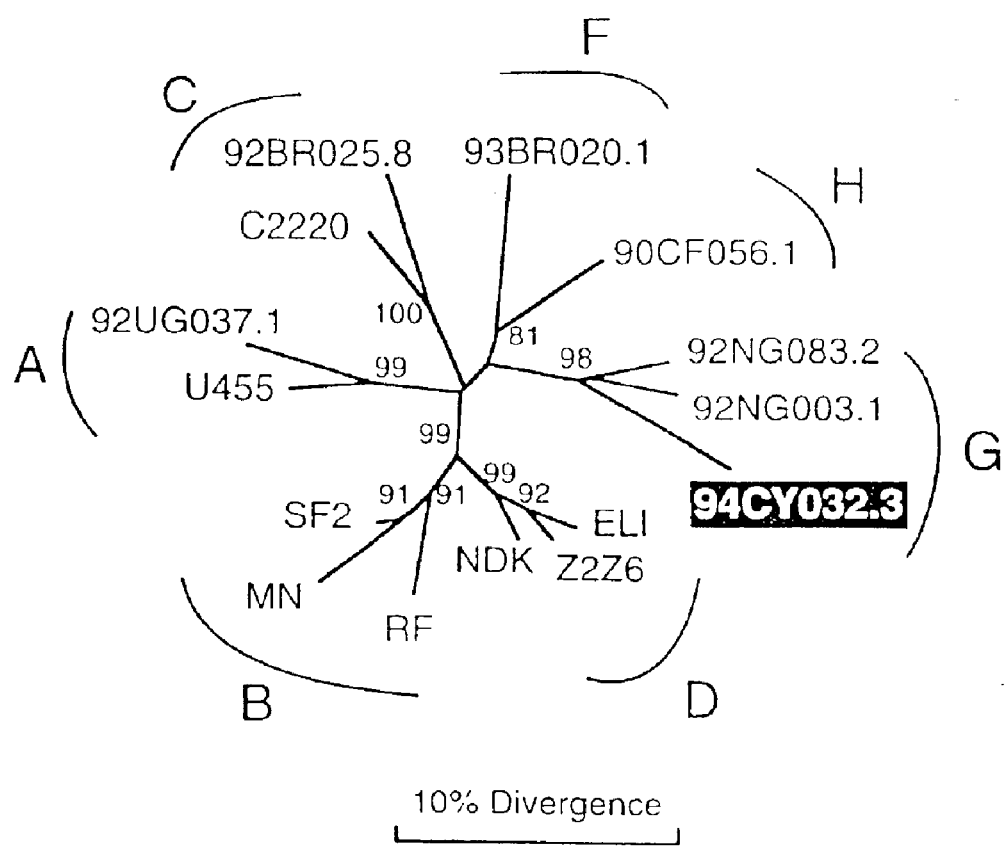
Figure 10C:
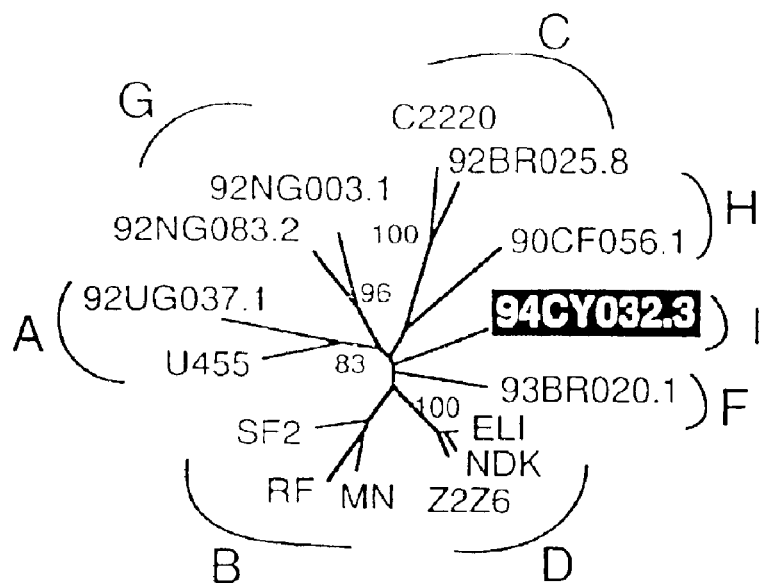
Figure 10D:
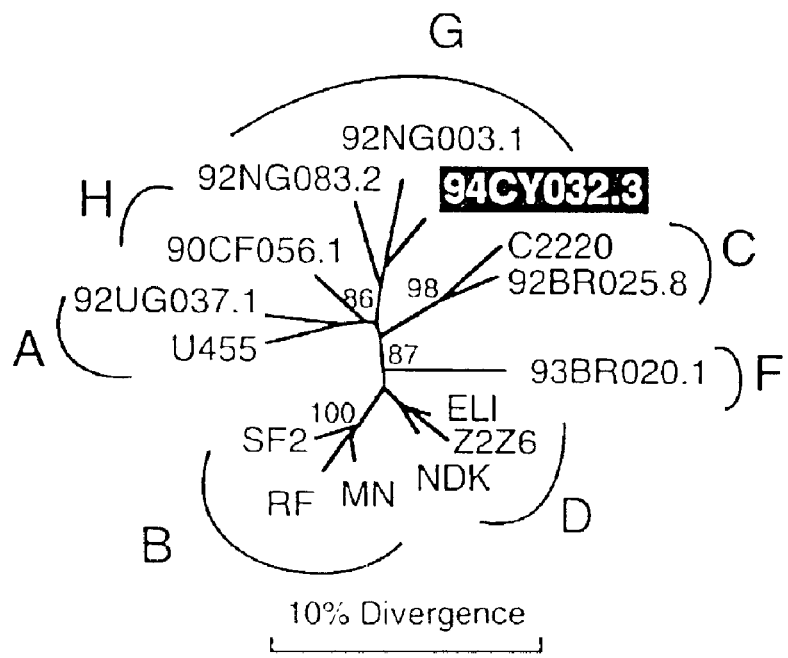
Figure 10E:
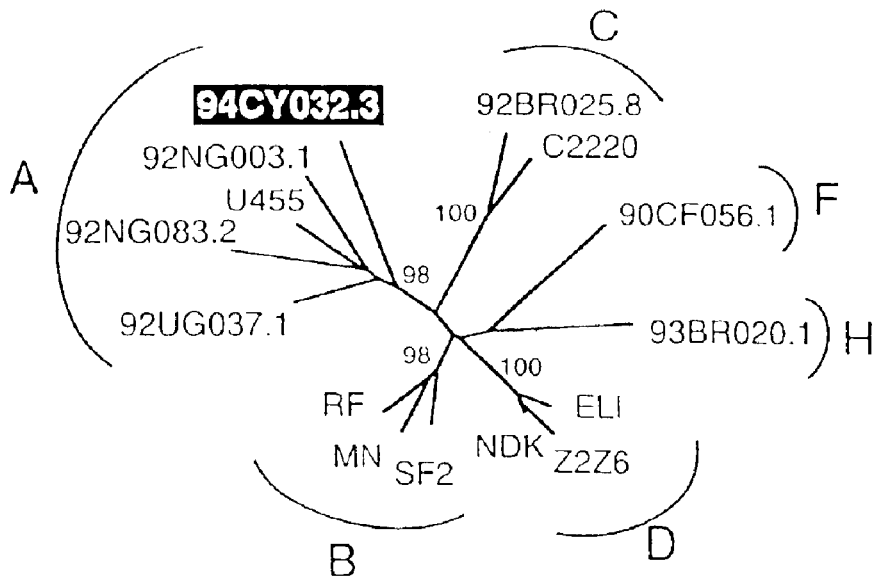
Figure 10F:
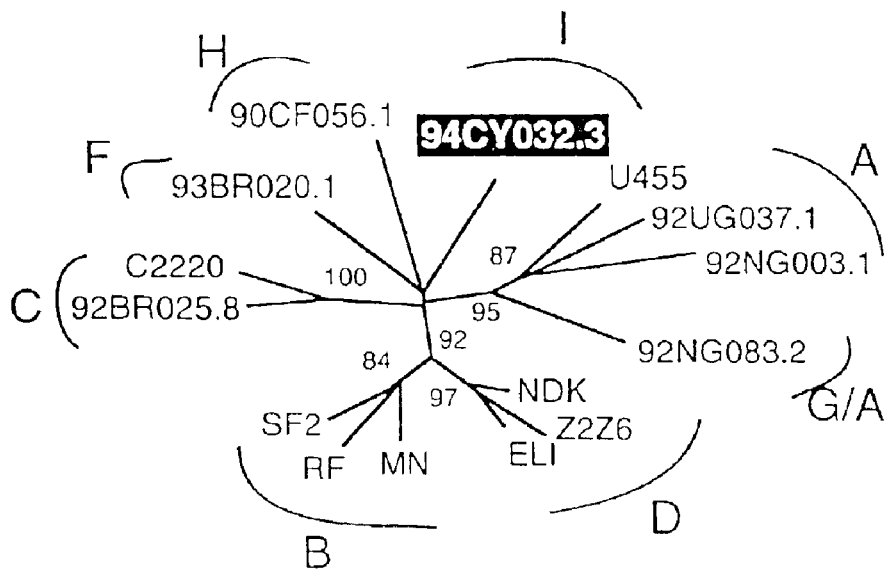
Figure 10G:
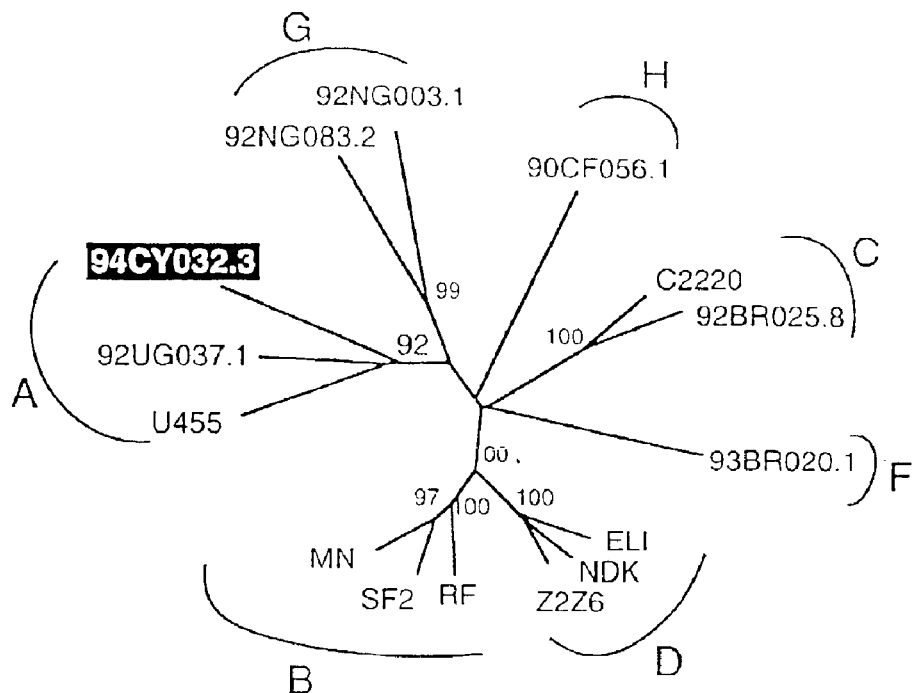
Figure 10H:
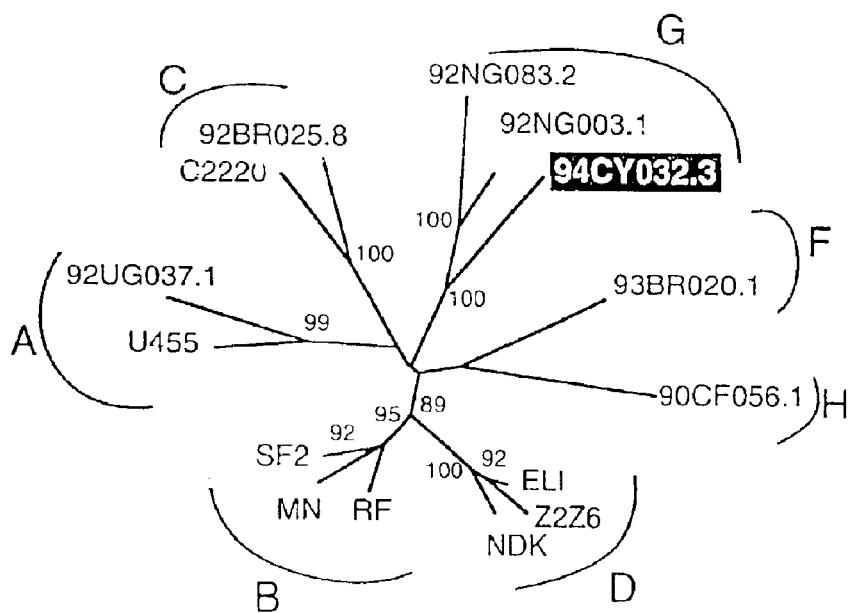
Figure 10I:
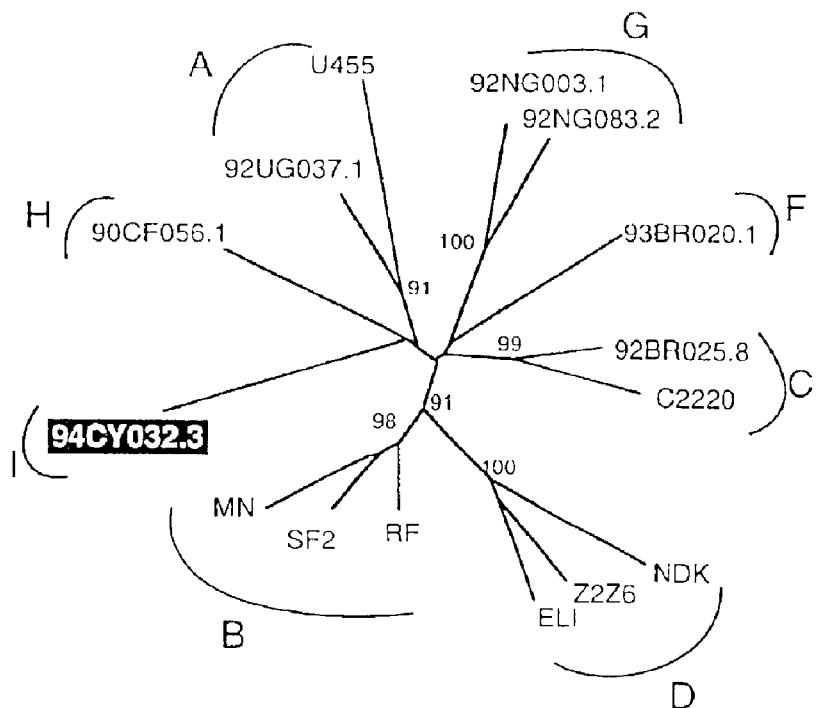
Figure 10J:
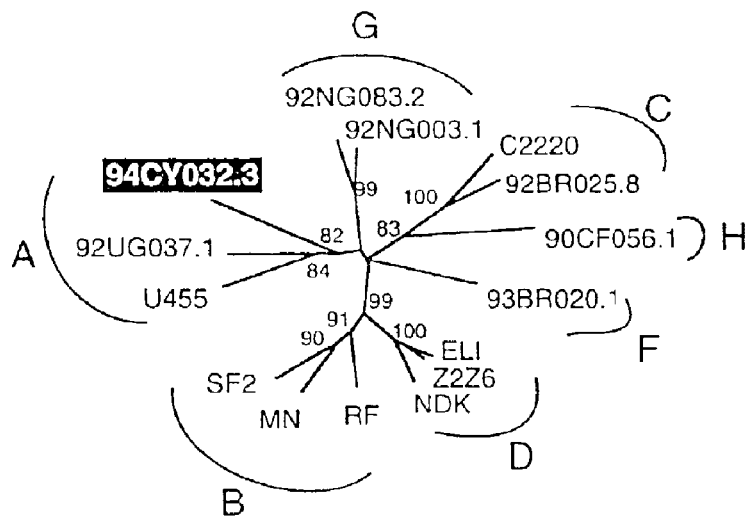
Figure 10K:
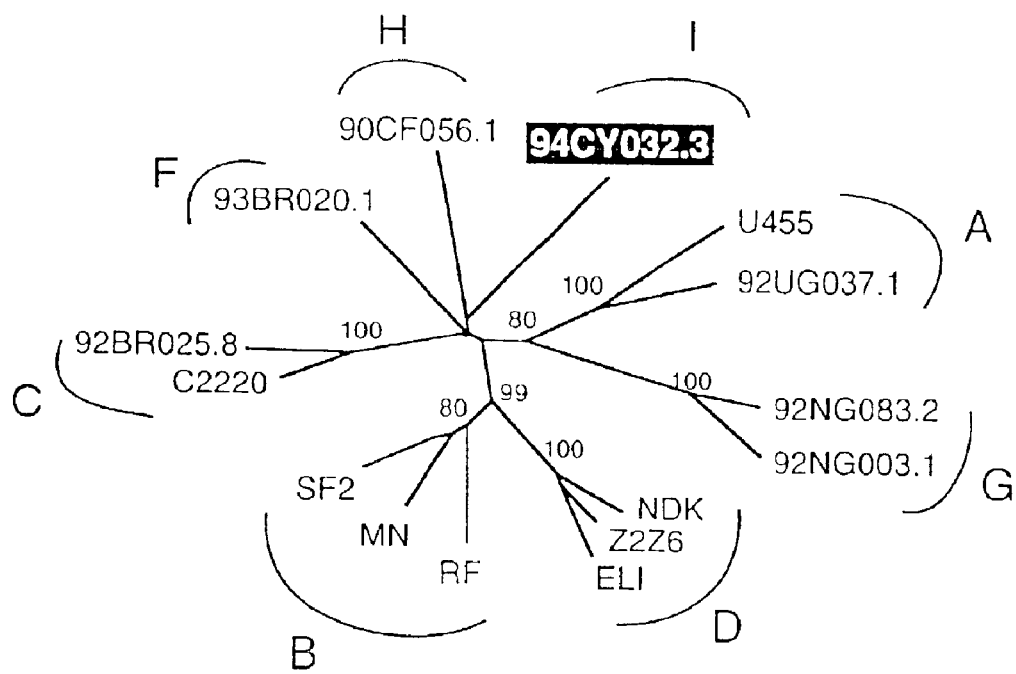

FIG. 9 depicts five such distance plots which illustrate the extent of sequence divergence of 94CY032.3 from representatives of subtypes A (92UG037.1), B (LAI), C (C2220), D (ELI) and G/(A) (92NG083.2). The analysis yielded a set of distance curves with very similar (and for the most part superimposable) diversity profiles, suggesting that 94CY032.3 was roughly equidistant from the other subtypes in most regions of its genome (the same results were also obtained when 94CY032.3 was compared to representatives of subtypes A/E, F, and H; data not shown). However, careful inspection of the graphs revealed several small areas of disproportionate sequence similarity involving two of the five reference sequences. For example, at the 3' end of gag and the 3' end of pol, 92NG083.3 dropped below all others, indicating a relative greater similarity of 94CY032.3 to subtype G. Similarly, in the 5' end of gag, vif and the 3' and 5' end of env, 92UG037.1 fell below all others, indicating a relative greater similarity of 94CY032.3 to subtype A. Together, these results suggested that 94CY032.3 contained subtype A and G-like segments, in addition to regions that appeared to be equidistant from the other subtypes.

Relative differences in the extent of sequence similarity as determined by diversity plots (18, 79) or other methods of distance measurement (75) are not always an indicator of recombination, but can reflect variations in the evolutionary rates of the lineages compared. To determine whether 94CY032.3 was truly mosaic, an exploratory tree analysis was then performed to look for significantly discordant phylogenetic positions for different parts of its genome (FIGS. 10A–10K). Using the same multiple genome alignment described above, but excluding all known recombinants (except 92NG083.3 and 92NG003.1), unrooted trees were constructed for overlapping fragments of 400 bp, moved in 10 bp increments along the alignment (for subtypes B and D only three representatives were included). Inspection of the resulting topologies revealed that 94CY032.3 changed its phylogenetic position a total of ten times, alternating between subtype A (FIGS. 10A, E, G and J; panels 201–600, 4241–4640, 5071–5470 and 6821–7220), subtype G (FIGS. 10B, D and H; panels 1101–1500, 3841–4240 and 5471–5870), and an independent position (FIGS. 10C, E, I and K; panels 1751–2150, 4641–5040, 5901–6300 and 7901–8300) that was very similar to the one observed in the C2-V3 region (all discordant positions were supported by significant bootstrap values). Since the latter has served as the basis for subtype I definition, it is most parsimonious to assume that all independently grouping segments in 94CY032.3 are of a common origin and thus represent "subtype I". 94CY032.3 thus appears to be comprised of sequences belonging to at least three different (group M) subtypes.

Figure 11:
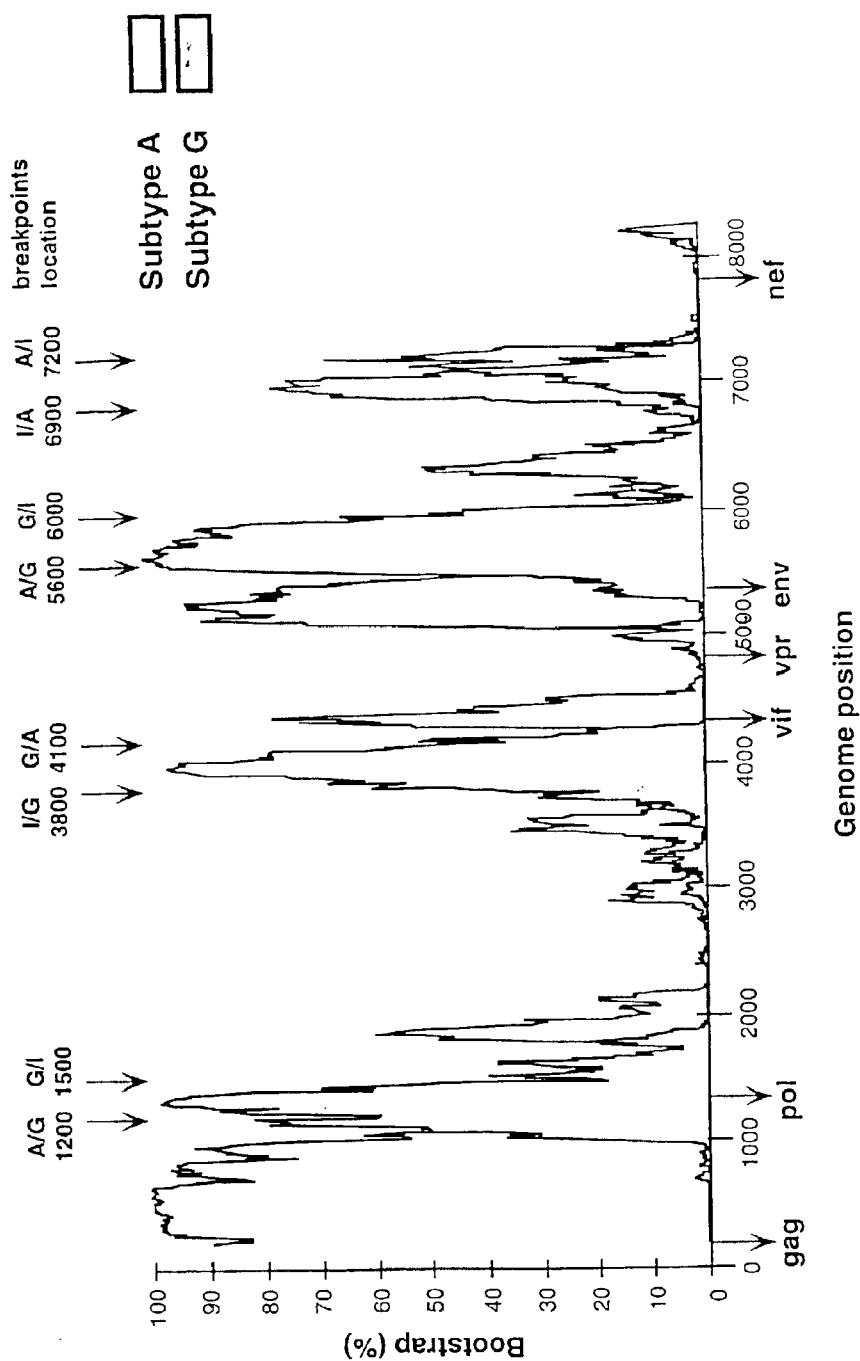
FIG. 11. Bootstrap plot analysis to map recombination breakpoints in 94CY032.3. Bootscanning was performed essentially as described, plotting the magnitude of the bootstrap value supporting the clustering of 94CY032.3 with 92UG037.1 (subtype A ) in comparison with that of 94CY032.3 and 92NG083.2 ("subtype G") for a window of 400 bp moved in increments of 10 bp along the alignment. Regions of subtype A or G origin are identified by very high bootstrap values (>80%). The location of eight recombination crossovers is indicated. Breakpoint analysis between position 4200 and 4800 was not possible due to the recombinant nature of 92NG083.2. The beginning of gag, pol, vif, vpr, env and nef open reading frames are shown. The y-axis indicates the percent bootstrap replicates, which support the clustering of 94CY032.3 with representatives of the respective subtypes.

To map the boundaries of the putative A, G and I segments, boostrap plot analyses were performed as previously described (18, 57, 79), plotting the magnitude of the bootstrap values that supported the clustering of 94CY032.3 with 92UG037.1 (subtype A), as well as that of 94CY032.3 with 92NG083.2 ("subtype G"). The results of these analyses allowed us to tentatively map the location and boundaries of the various subtype A an G segments along the 94CY032.3 genome (FIG. 11). Bearing in mind the window size of 400 nucleotides and considering only peaks of significant bootstrap values (>80%), we identified two A/G cross-overs around 1200 and 5600, and one G/A cross-over around 4100. The bootstrap plots also outlined regions with no peaks (or peaks below 80%), which coincided with segments that clustered independently (i.e., in subtype I) in the exploratory tree analysis. Delineating the boundaries of these regions suggested five additional breakpoints: G/I at 1500, I/G at 3800, G/I at 6000, I/A at 6900, and A/I at 7200. Because full length non-mosaic reference sequences for the parental lineages (G and I) were not available, most of the breakpoints could not be mapped with certainty (the A/G breakpoints at 1200 and 5600 were confirmed by informative site analysis; data not shown). Also, the recombinant nature of 92NG083.2 prohibited reliable breakpoint analysis between 4200 and 4800 (32, 79; highlighted in FIG. 11).

Figure 12:
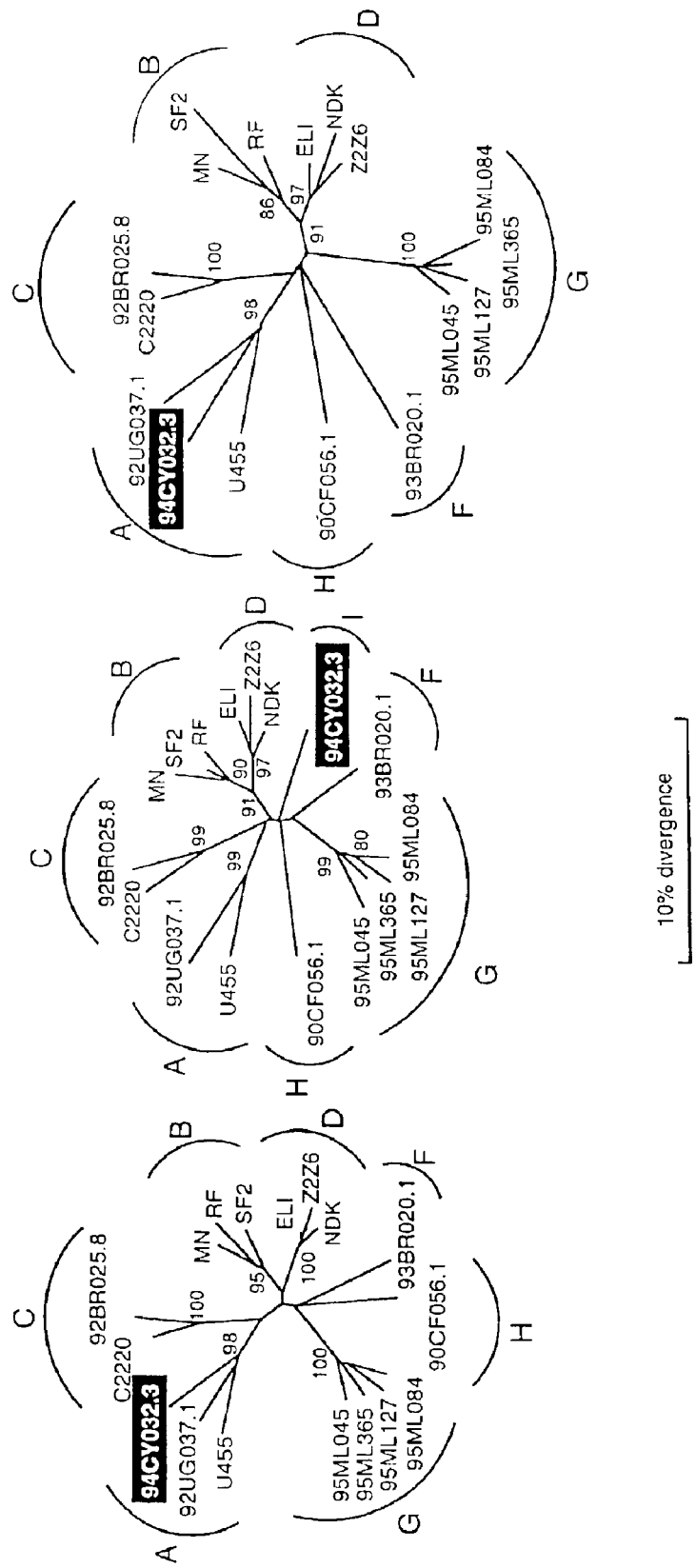
FIG. 12. Recombination breakpoint analysis of 94CY032.3 in the vif/vpr region. Neighbor joining trees depicting the position of 94CY032.3 in regions flanking the breakpoints identified by distance plot analysis (not shown). Trees were constructed from the genomic regions indicated. Subtypes are identified by brackets. Four sequences from Mali represent subtype G (these are the only available subtype G reference sequences in this region, since all other "subtype G" viruses contain A fragments). Numbers at nodes indicate the percentage of bootstrap values with which the adjacent cluster is supported (only values above 80% are shown). Branch lengths are drawn to scale.

To map potential recombination breakpoints in this remaining region, four recently reported, partial but non-mosaic subtype G sequences from Mali which spanned the vif/vpr region and thus bridged the "subtype A gap" of 92NG083.2 were used (77). A set of distance plots that compare 94CY032.3 to one of these newly derived G sequences (95ML045) as well as representatives of subtype A (U455), B (MN), and D (ELI), respectively, were constructed (data not shown). Consistent with the results from the exploratory tree analysis (FIG. 4), 94CY032.3 was disproportionately more closely related to U455 in the 5' and 3' thirds of this fragment, suggesting the presence of subtype A-like segments. However, in the middle of the fragment, 94CY032.3 was clearly equidistant from U455 and the other subtypes, suggesting an independent position (diversity plots were generated for a window of 300 bp moved in increments of 10 bp). Thus, noting the points at which the "A" distance increased and decreased relative to the other distances allowed us to tentatively map the two remaining breakpoints, one at 4650 and the other at 5000. Trees constructed from sequences surrounding these two breakpoints (FIG. 12) confirmed that 94CY032.3 switched position from subtype A (FIG. 12; panel 4255–4650) to subtype I (panel 4651–5000), and back to subtype A (5001–5300; note, that the new subtype G sequences only cover the region between 4255 and 5300).

There are a total of 10 recombination breakpoints between the 5' end of gag and the 3' end of nef in the genome structure of the 94CY032.3. However, the discordant subtype assignments of gag and nef regions necessitate at least one more breakpoint in the viral LTR or the gag leader sequence (LTR sequences were not separately analyzed for mosaicism). Given this extent of mosaic complexity, 94CY032.3 is likely the result multiple sucessive recombination events.

Having identified several fragments of subtype I in 94CY032.3, evidence for its presence in other (full length) recombinants from the database was examined. (Data not shown) Two known mosaics MAL (53, 76) and Z321 (78) were of particular interest, because previous analyses had indicated that these viruses contain regions of uncertain subtype assignment (53, 82, 83). For example, MAL has long been known to represent a mosaic of subtypes A and D, but also contains a sizable pol fragment that has defied previous subtype classification (53, 83). Similarly, Z321 is a known mosaic .of subtypes A and G (78), but a recent re-analysis of its recombination breakpoints identified regions that could not be assigned to any known subtype (82, 83). To determine whether any of these regions represented subtype I, distance plot analysis was performed, comparing the diversity profiles of MAL and Z321 with those for representatives of other subtypes. Looking for dips in the curves as an indication of relatively greater sequence similarity, one in the pol region of MAL and another in the vif/vpr region of Z321 were found to coincide with previously unclassified segments of their genomes (indicated as white boxes). Phylogenetic tree analysis confirmed that these regions were indeed of subtype I origin, since MAL and Z321 clustered significantly with the subtype I domains of 94CY032.3. Interestingly, subtype I did not account for all of the unclassifiable regions in MAL and Z321 (82, 83). It thus remains unclear whether these represent still other, as yet unidentified, subtypes or regions of multiple breakpoints that cannot be mapped using current methods.

The above results demonstrate that a strain of HIV-1, proposed in 1995 as a prototypic "subtype I" isolate (29), represents a complex mosaic comprised of subtypes A, G and I, respectively. In addition, two of the oldest known isolates from Africa, MAL (isolated in 1984) (76) and Z321 (isolated in 1976) (80, 84), are shown to contain short segments of sequence closely related to the subtype I domains of 94CY032.3. These findings support the following conclusions: (i) although initially detected in Cyprus, subtype I must have existed in Africa as early as 1976; it is unknown whether full length non-mosaic representatives of subtype I still exist (but have not yet been sampled), or whether this subtype (like subtype E) is represented only by fragments in present day recombinants; (ii) the ancestry of 94CY032.3 must have involved multiple successive recombination events; it remains unclear whether this occurred in Africa and/or in Cyprus, where a number of different subtypes have also been documented (29); (iii) subtype I, along with subtypes A and G, must have diverged substantially earlier than the 1970s in order to be detectable as distinct segments in the Z321 genome; this is consistent with the recent molecular characterization of a virus from 1959 which in phylogenetic analyses appears to have postdated the group M radiation (85); (iv) finally, the finding of subtype I in several different recombinants, including one from an intravenous drug user (29), suggests that this subtype may be more widespread than previously thought, at least in the form of mosaic genome fragments. It will be interesting to screen additional viruses from drug user populations and their contacts in Cyprus and Greece to determine the current prevalence and geographic distribution of subtype I containing viruses.

The following references are cited herein:
1. Abimiku, A. G., et al., 1994. Subgroup G HIV type 1 isolates from Nigeria. *AIDS Res. Hum. Retroviruses* 10:1581–1583.
2. Ausubel, F. M., et al., 1987. Current protocols in molecular biology. John Wiley & Sons, New York.
3. Betts, M. R., et al., 1997. Cross-clade HIV-specific cytotoxic T-lymphocyte responses in HIV-infected Zambians. *J. Virol.*, 71:8908–8911.
4. Bobkov, A., et al., 1996. Complex mosaic structure of the partial envelope sequence from a Gambian HIV Type 1 Isolate. *AIDS Res. Hum. Retroviruses* 12:169–171.
5. Brodine, S. K., J. R. Mascola, and F. E. McCutchan. 1997. Genotypic variation and molecular epidemiology of HIV. *Infect .Med.*, 14: 739–748.
6. Cao, H., et al., 1997. Cytotoxic T-lymphocyte cross-reactivity among different human immunodeficiency virus type 1 clades: Implications for vaccine development. *J. Virol.* 71:8615–8623.
7. Carr, J. K., et al., 1996. Full length sequence and mosaic structure of a human immunodeficiency virus type 1 isolate from Thailand. *J. Virol.* 70:5935–5943.
8. Cornelissen, M., et al., 1996. Human immunodeficiency virus type 1 subtypes defined by env show high frequency of recombinant gag genes. *J. Virol.* 70:8209–8212.
9. Dittmar, M. T., et al., 1997. Langerhans cell tropism of human immunodeficiency virus type 1 subtype A through F isolates derived from different transmission groups. *J. Virol.* 71:8008–8013.
10. Dolin, R. 1995. Human studies in the development of human immunodeficiency virus vaccines. *J. Infect. Dis.* 172:1175–1183.
11. Esparaza, J., S. Osmanov, and W. Heyward. 1995. HIV preventive vaccines. *Drugs* 50:792–804.
12. Faulkner, D. M., and J. Jurka. 1988. Multiple aligned sequence editor (MASE). *Trends Biochem. Sci.* 13:321–322.
13. Felsenstein, J. 1985. Confidence limits on phylogenies: an approach using the boostrap. *Evolution* 39:783–791.
14. Felsenstein, J. 1992. PHYLIP (Phylogeny Inference Package), 3.5c ed. Department of Genetics, University of Washington, Seattle, Wash.
15. Ferrari, G., et al., 1997. Clade B-based HIV-1 vaccines elicit cross-clade cytotoxic T lymphocyte reactivities in uninfected volunteers. *Proc. Natl. Acad. Sci. USA* 94:1396–1401.
16. Gao, F. and B. H. Hahn, unpublished.
17. Gao, F., et al., 1994. Genetic variation of HIV type 1 in four World Health Organization-sponsored vaccine evaluation sites: generation of functional envelope (glycoprotein 160) clones representative of sequence subtypes A, B, C, and E. *AIDS Res. Hum. Retroviruses* 10:1359–1368.
18. Gao, F., et al., 1996. The heterosexual human immunodeficiency virus type 1 epidemic in Thailand is caused by an intersubtype (A/E) recombinant of African origin. *J. Virol.* 70:7013–7029.
19. Gao, F., et al., 1996. Molecular cloning and analysis of functional envelope genes from HIV-1 sequence subtypes A through G. *J. Virol.* 70:1651–1667.
20. Ghosh, S. K., et al., 1993. A molecular clone of HIV-1 tropic and cytopathic for human and chimpanzee lymphocytes. *Virology* 194:858–864.
21. Graham, B. S., and P. F. Wright. 1995. Candidate AIDS Vaccines. *N. Engl. J. Med.* 333:1331–1339.
22. Hahn, B. H., et al., 1984. Molecular cloning and characterization of the HTLV-III virus associated with AIDS. *Nature* 312:166–169.
23. Hahn, B. H., D. L. Robertson, and P. M. Sharp. 1995. Intersubtype recombination in HIV-1 and HIV-2, p. III-22-III-29. In G. Myers and B. Korber and S. Wain-Hobson and K.-T. Jeang and L. E. Henderson and G. N. Pavlakis (ed.), Human retroviruses and AIDS1995: A compilation and analysis of nucleic acid and amino acid sequences.
Los Alamos National Laboratory, Los Alamos, N. Mex.
24. Hu, D. J., et al., 1996. The emerging diversity of HIV: the importance of global surveillance for diagnostics, research and prevention. *JAMA* 275:210–216.
25. Kalish, M. L., et al., 1995. The evolving molecular epidemiology of HIV-1 envelope subtypes in injecting drug users in Bangkok, Thailand: implications for HIV vaccine trials. *AIDS* 9:851–857.
26. Kimura, M. 1980. A simple method for estimating evolutionary rates of base substitutions through comparative studies of nucleotide sequences. *J. Mol. Evol.* 16:111–120.
27. Kimura, M. 1983. The neutral theory of molecular evolution. Cambridge University Press, Cambridge, U.K.
28. Korber, B. T. M., et al., . 1994. The World Health Organization Global Programme on AIDS Proposal for Standardization of HIV Sequence Nomenclature. *AIDS Res. Hum. Retroviruses* 10:1355–1358.
29. Kostrikis, L. G., et al., 1995. Genetic analysis of human immunodeficiency virus type 1 strains from patients in Cyprus: Identification of a new subtype designated subtype I. *J. Virol.* 69:6122–6130.
30. Leitner, T., and J. Albert. 1995. A new genetic subtype of HIV-1, p. III-147–III-150. In G. Myers and B. Korber and B. H. Hahn and K.-T. Jeang and J. W. Mellors and F. E. McCutchan and L. E. Henderson and G. N. Pavlakis (ed.), Human Retroviruses and AIDS 1995. Theoretical Biology and Biophysics, Los Alamos.
31. Leitner, T., et al., 1995. Biological and molecular characterization of subtype D, G, and A/D recombinant HIV-1 transmissions in Sweden. *Virology* 209:136–146.
32. Leitner, T., B. T. M. Korber, D. L. Robertson, F. Gao, and B. H. Hahn. 1997. Updated Proposal of Reference Sequences of HIV-1 Genetic Subtypes. In B. Korber, B. Foley, C. Kuiken, T. Leitner, F. McCutchan, J. W. Mellors and B. H. Hahn (ed), Human Retroviruses and AIDS 1997: a complication and analysis of nucleic acid and amino acid sequence. Theoretical Biology and Biophysics Group, Los Alamos National Laboratory, Los Alamos, N. Mex.
33. Loussert-Ajaka, I., et al., 1995. Variability of human immunodeficiency virus type 1 group O strains isolate from Cameroonian patients living in France. *J. Virol.* 69:5640–5649.
34. Louwagie, J., et al., 1993. Phylogenetic analysis of gag genes from 70 international HIV-1 isolates provides evidence for multiple genotypes. *AIDS* 7:769–780.
35. Louwagie, J., et al., 1995. Genetic diversity of the envelope glycoprotein from human immunodeficiency virus type 1 isolates of African origin. *J. Virol.* 69:263–271.
36. Maniatis, T., E. F. Fritsch, and J. Sambrook. 1982. Molecular cloning: a laboratory manual, p. 269–295. Cold Spring Harbor Laboratory, Cold Spring Harbor, N.Y.
37. Martin-Gallardo, A., J. Lamerdin, and A. Carrano. 1994. Shotgun sequencing, p. 37–41. In M. D. Adams and C. Fields and J. C. Venter (ed.), Automated DNA sequencing and analysis. Academic Press, London.
38. Mascola, J. R., et al., 1996. Human immunodeficiency virus type 1 neutralizing antibody serotyping using serum pools and an infectivity reduction assay. *AIDS Res. Hum. Retroviruses* 12:1319–1328.
39. McCutchan, F. E., et al., 1992. Genetic variants of HIV-1 in Thailand, *AIDS Res. Hum. Retroviruses* 8:1887–1895.
40. McCutchan, F. E., M. O. Salminen, J. K. Carr, and D. S. Burke. 1996. HIV-1 genetic diversity. *AIDS* 10(suppl 3):S13–20.
41. Moore, J. P., et al., 1996. Inter- and intra-subtype neutralization of human immunodeficiency virus type 1: the genetic subtypes do not correspond to neutralization serotypes but partially correspond to gp120 antigenic serotypes. *J. Virol.* 70:427–444.
42. Moore, J., and A. Trkola. 1997. HIV type 1 coreceptors, neutralization serotypes, and vaccine development. *AIDS Res. Hum. Retroviruses* 13:733–736.
43. Murphy, E., et al., 1993. Diversity of V3 region sequences of human immunodeficiency viruses type 1 from the Central African Republic. *AIDS Res. Hum. Retroviruses* 9:997–1007.

44. Myers, G., et al., 1992. Human retroviruses and AIDS: a compilation and analysis of nucleic acid and amino acid sequence. Theoretical Biology and Biophysics Group, Los Alamos National Laboratory, Los Alamos, N. Mex.
45. Myers, G., et al., 1996. Human retroviruses and AIDS: A compilation and analysis of nucleic acid amino acid sequences. Theoretical Biology and Biophysics Group, Los Alamos National Laboratory, Los Alamos, N. Mex.
46. Nyambi, P. N., et al., 1996. Multivariate analysis of human immunodeficiency virus type 1 neutralization data. *J. Virol.* 70:445–458.
47. Ou, C.-Y., et al., 1993. Independent introductions of two major HIV-1 genotypes into distinct high-risk populations in Thailand. *Lancet* 341:1171–1174.
48. Peden, K., M. Emerman, and L. Montagnier. 1997. Changes in growth properties on passage in tissue culture of viruses derived from infectious molecular clones of HIV-1LAI, HIV-1MAL, and HIV-1ELI. *Virology* 185:661–672.
49. Perriére, G. and Gouy, M. 1996. WWW-Query: An on-line retrieval system for biological sequence banks. Biochimie 78: 364–369.
50. Pope, M., et al., 1997. HIV-1 strains from subtypes B and E replicate in cutaneous dendritic cell-T cell mixtures without displaying subtype-specific tropism. *J. Virol.* 71:8001–8007.
51. Pope, M., et al., 1997. Different subtypes of HIV-1 and cutaneous dendritic cells. *Science* 278:786–787.
52. Robertson, et al., 1995. Recombination in HIV-1. *Nature* 374:124–126.
53. Robertson, D. L., B. H. Hahn, and P. M. Sharp. 1995. Recombination in AIDS viruses. *J. Mol. Evol.* 40:249–259.
54. Sabino, E. C., et al., 1994. Identification of human immunodeficiency virus type 1 envelope genes recombinant between subtypes B and F in two epidemiologically linked individuals from Brazil. *J. Virol.* 68:6340–6346.
55. Saitou, N., and M. Nei. 1987. The neighbor-joining method: a new method for reconstructing phylogenetic trees. *Mol. Biol. Evol.* 4:406–425.
56. Salminen, M. O., et al., 1995. Recovery of virtually full length HIV-1 provirus of diverse subtypes from primary virus cultures using the polymerase chain reaction. *Virology* 213:80–86.
57. Salminen, M. O., J. K. Carr, D. S. Burke, and F. E. McCutchan. 1995. Identification of breakpoints in inter-genotypic recombinants of HIV-1 by bootscanning. *AIDS Res. Hum. Retroviruses* 11:1423–1425.
58. Salminen, M. O., J. K. Carr, D. S. Burke, and F. E. McCutchan. 1995. Genotyping of HIV-1, p. III-30–III-34. In G. Myers and B. Korber and S. Wain-Hobson and K.-T. Jeang and L. E. Henderson and G. N. Pavlakis (ed.), Human retroviruses and AIDS 1995: A compilation and analysis of nucleic acid and amino acid sequences. Los Alamos National Laboratory, Los Alamos.
59. Salminen, M. O., et al., 1996. Full length sequence of an ethiopian human immunodeficiency virus type 1 (HIV-1) isolate of genetic subtype C. *AIDS Res. Hum. Retroviruses* 12:1329–1339.
60. Salminen, M. O., et al., 1997. Evolution and probable transmission of intersubtype recombinant human immunodeficiency virus type 1 in a Zambian couple. *J. Virol.* 71:2647–2655.
61. Sharp, P. M., D. L. Robertson, F. Gao, and B. H. Hahn. 1994. Origins and diversity of human immunodeficiency viruses. *AIDS* 8:S27–S42.
62. Sharp, P. M., D. L. Robertson, and B. H. Hahn. 1995. Cross-species transmission and recombination of AIDS viruses. *Phil. Trans. R. Soc. London (Ser. B)* 349: 41–47.
63. Siepel, A. C., and B. T. Korber. 1995. Scanning the database for recombinant HIV-1 genomes, p. III-35–III-60. In G. Myers and B. Korber and S. Wain-Hobson and K.-T. Jeang and L. E. Henderson and G. N. Pavlakis (ed.), Human retroviruses and AIDS 1995: A compilation and analysis of nucleic acid and amino acid sequences. Los Alamos National Laboratory, Los Alamos, N. Mex.
64. Soto-Ramirez, L. E., et al., 1996. HIV-1 langerhans' cell tropism associated with heterosexual transmission of HIV. *Science* 271:1291–1293.
65. Spire, B., et al., 1989. Nucleotide sequence of HIV1-NDK: a highly cytopathic strain of the human immunodeficiency virus. *Gene* 81:275–284.
66. Takehisa, J., et al., 1997. Phylogenetic analysis of human immunodeficiency virus 1 in Ghana. *Acta. Virologia* 41:51–54.
67. Thompson, J. D., D. G. Higgins, and T. J. Gibson. 1994. CLUSTAL W—improving the sensitivity of progressive multiple sequence alignment through sequence weighting, position-specific gap penalties and weight matrix choice. *Nucleic Acids Res.* 22:4673–4680.
68. Weber, J., et al., 1996. Neutralization serotypes of human immunodeficiency virus type 1 field isolates are not predicted by genetic subtype. *J. Virol.* 70:7827–7832.
69. Weniger, B. G., et al., 1991. The epidemiology of HIV infection in AIDS in Thailand. *AIDS* 5(suppl. 2):S71–S85.
70. Weniger, B. G., et al., 1994. The molecular epidemiology of HIV in Asia. *AIDS* 8(suppl. 2):S13–S28.
71. Wieland, U., et al., 1997. Diversity of the vif gene of human immunodeficiency virus type 1 in Uganda. *J. of Gen. Virol.* 78:393–400.
72. World Health Organization Network for HIV Isolation and Characterization. 1994. HIV-1 variation in WHO-sponsored vaccine-evaluation sites: Genetic screening, sequence analysis and preliminary biological characterization of selected viral strains. *AIDS. Res. Hum. Retroviruses* 10:1327–1344.
73. Zhang, L., et al., 1996. HIV-1 subtype and second-receptor use. *Nature (London)* 383:768.
74. Zhang, L., et al., 1997. HIV-1 subtypes, co-receptor usage, and CCR5 polymorphism. *AIDS Res. Hum. Retroviruses* 13: 1357–1366
75. Siepel, A. C., et al., A computer program designed to screen rapidly for HIV type 1 intersubtype recombinant sequences. *AIDS Res. Hum. Retrovirus.* 11: 1413–1416, 1995
76. Alizon, M., S. et al., 1986. Genetic variability of the AIDS virus: nucleotide sequence analysis of two isolates from African patients. *Cell* 46:63–74.
77. Bibollet-Ruche, F., et al., Genetic characterization of accessory genes from human immunodeficiency virus type 1 subtypes A, C, D, F, G and H from different African countries, in preparation.
78. Choi, D. J., et al., 1997. HIV type 1 isolate Z321, the strain used to make a therapeutic HIV type 1 immunogen, is intersubtype recombinant. *AIDS Res. Hum. Retroviruses* 13:357–361.
79. Gao, F., et al., 1998. A comprehensive panel of near full-length clones and reference sequences for non-subtype B isolates of human immunodeficiency virus type 1. *J. Virol*, in press.
80. Getchell, J. P., et al., 1987. Human immunodeficiency virus isolated from a serum sample collected in 1976 in Central Africa. *J. Infect. Dis.* 156:833–837.
81. B. Korber, et al., 1997. Human retroviruses and AIDS: A compilation and analysis of nucleic acid and amino acid sequences. Theoretical Biology and Biophysics Group, Los Alamos National Laboratory, Los Alamos, N. Mex.

82. Robertson, D. L., F. Gao, and B. H. Hahn. The analysis of complete HIV-1 intersubtype hybrid genomes, in preparation.
83. Robertson, D. L., et al., 1997. Intersubtype Recombinant HIV-1 Sequences. pp. III 25–III 30, In B. Korber, B. Foley, C. Kuiken, T. Leitner, F. McCutchan, J. W. Mellors, and B. H. Hahn (ed.), Human retroviruses and AIDS 1997: A compilation and analysis of nucleic acid and amino acid sequences. Theoretical Biology and Biophysics Group, Los Alamos National Laboratory, Los Alamos, N. Mex.
84. Srinivasan, A., D. et al., 1989. Molecular characterization of HIV-1 isolated from a serum collected in 1976: Nucleotide sequence comparison. of recent isolates and generation of hybrid HIV. *AIDS Res. Hum. Retroviruses* 5:121–129.
85. Zhu, T., et al., 1998. An African HIV-1 sequence from 1959 and implications for the origin of the epidemic. *Nature* 391:594–597.
86. Southern, E. M. 1975. *J. Mol. Biol.*, 98:503–517.
87. Kafatos, F. C. et al. 1979. *Nucleic Acids Res.*, 7:1541–1522
88. Agarwal et al. 1972,*Angew. Chem. Int. Ed. Engl.* 11:451.
89. Baeucage et al. 1981, *Tetrahedron Letters* 22:1859–1862. Automated diethylphosphoramidite method.
90. Hsiung et al. 1979. *Nucleic Acids Res* 6:1371
91. See, e.g., Anderson, et al. 1996. *Antimicrob. Agents Chemother.*, 40:2004–2011; Azad, et al. 1995. *Antiviral Res.*, 28:101–111; Azad, et al. 1993. *Antimicrob. Agents Chemother.*, 37:1945–1954; Leeds, et al. 1997. *Drug. Metab. Dispos.*, 25:921–926;

and references therein. See also, Cook, P. D., 1993. Monomers for preparation of oligonucleotides having chiral phosphorus linkages. U.S. Pat. No. 5,212,295 (re: general method of making DNA analogs, including phosphorothioates, thioesters, etc.); and Iyer et al. 1990*J. Org. Chem.* 55:4693–4699 (re: synthetic method for making phosphorothioate oligos).
92. See, e.g., Nielsen, et al., WO 98/03542; Hyrup and Nielsen 1996. *Bioorg. Med Chem.* 4:5–23; and Nielsen, et al. 1991. *Science* 254:1497–1500; and references therein.
93. Sambrook, J. et al. 1989. In "Molecular Cloning, A Laboratory Manual", Cold Spring Harbor Press, Plainview, N.Y.
94. Alwine, J. C., et al. 1977. *Proc. Natl. Acad. Sci.*, 74:5350–5354.
95. Hollander, M. C. et al. 1990. *Biotechniques;* 9:174–179
96. Watson, J. D., et al. 1992. In "Recombinant DNA" Second Edition, W. H. Freeman and Company, New York.
97. See, e.g., Naldini, N., et al., "In Vivo Gene Delivery and Stable Transduction of Nondividing Cells by a Lentiviral Vector", *Science*, 272:263–267 (1996);

Srinivasakumar, N., et al., "The Effect of Viral Regulatory Protein Expression on Gene Delivery by Human Immunodeficiency Virus Type 1 Vectors Produced in Stable Packaging Cell Lines", *J. Virol.*, 71:5841–5848 (August. 1997); Zufferey, R., et al., "Multiply Attenuated Lentiviral Vector Achieves Efficient Gene-Delivery In Vivo", *Nature Biotechnology*, 15:871–875 (September 1997); and Kim, V. N., et al., "Minimal Requirement for a Lentivirus Vector Based on Human Immunodeficiency Virus Type 1", *J. Virol.*, 72:811–816 (January 1998).
98. See, e.g., Schwartz et al.,*J. Virol.*, 66:7176–7182 (1992); International Publication No. WO 93/20212 (1993); Schneider, R., et al., "Inactivation of the human immunodeficiency virus type 1 inhibitory elements allows Rev-independent expression of Gag and Gag/protease and particle formation," *J. Virol.*, 71:4892–4903 (1997) concerning the identification and mutation of inhibitory and instability regions using multiple point mutations within HIV-1 gag, protease and pol coding regions to reduce the effects of these regions and increase expression of the encoded polypeptide.
99. Oellerich, M. 1984. J. Clin. Chem. Clin. BioChem 22:895–904
100. Lu S., et al. Simian immunodeficiency virus DNA vaccine trial in macaques. *J. Virol.* 1996;70:3978–91.
101. Haynes J R, et al., Accell particle-mediated DNA immunization elicits humoral, cytotoxic and protective responses. *AIDS Res. Hum. Retroviruses* 1994; 10 (suppl 2): S43–45
102. Okuda, K, et al. Induction of potent humoral and cell-mediated immune responses following direct injection of DNA encoding the HIV type 1 Env and Rev gene products. *AIDS Res. Hum. Retroviruses* 1995;11:933–43
103. Wang B., et al. Induction of humoral and cellular immune responses to the human immunodeficiency type 1 virus in non-human primates by in vivo DNA inoculation. *J. Virol.* 1995;21:102–12
104. Boyer J D, et al. In vivo protective anti-HIV immune responses in non-human primates through DNA immunization. *J. Med. Primatol.* 1996; 25–242–50
105. MacGregor et al., *J. Infect. Dis.* 178:92–100 (1998)
106. Donnelly et al., *Annu. Rev. Immunol.* 15:617–648 (1997)
107. Ulmer et al., *Science* 259:1745–1749 (1993)
108. Winzeler et al., *Science* 281:1194–1197 (1998)

Modifications of the above described invention that are obvious to those of skill in the fields of genetic engineering, immunology, virology, protein chemistry, medicine, and related fields are intended to be within the scope of the following claims.

All of the references cited herein above are hereby incorporated by reference.

SEQUENCE LISTING (270 sequences)

SEQ ID NO: 1 - DNA, 8968 bp, Human immunodeficiency virus type 1
  isolate=93BR020; 133..1611:gag; 4369.4947:vif; 4887.5177:vpr; 5158.7767:tat; 5297.7957:rev; 5396.5641:vpu; 5559.8099:env; 8101.8727:nef
ctgaaagcgaaagtaaaccagagaagaactctcgacgcaggactcggcttgctgaagtgcacacggcaagaggcgagagcggcgactggtgagtacgccaaaatttgactagcagaggctagaaggagagagatgggtgcgagagcgtcagtattaagcgggggaaaattagatgcttgggaaaaaattcggttaaggccggggggaaagaaaaaatatagactaaaacatctagtatgggcaagcagggagctagaacgatttgcacttgatccaggccttctagaaacatcagaaggctgtcgaaaaataataggacagttacaaccatcccttcagacaggatcagaagagctcaaatcattatataatacaatagcagtcctctattatgtacatcaaaaggtagaggtaaaagacaccaaggaggctttagagaagctagaggaagaacaaaacaaaggtcggcaaaagacacagcaagcgactgctgaaaaaggggtcagtcaaaattaccctatagtacagaatcttcagggacaaatggtacaccagtctttatcacctagaactttaaatgcatgggtaaaggtgatagaagagaaggcttttagtccagaagtaatacccatgttttcagcattatcagaaggggccactccacaagatttaaacaccatgttaaatacagtggggggacatcaagcagccatgcaaatgttaaaagacaccatcaatgaggaggctgcagaatgggacagattacatccaacacaggcaggacccatccccccaggtcagataagggaacctaggggaagtgatatagctggaactactagtacccttcaggaacaaatacaatggatgacaggcaacccacctgtcccagtgggagaaatgtataaaagatggatcatcctaggattaaataaaatagtaagaatgtatagccctgtcggcattttggacataagacaagggccaaaagaaccctttagagactatgtagacaggttctttaaaaccctaagagctgagcaagctacacaggaagtaaagggttggatgacagacaccttgttggtccaaaatgcgaacccagattgtaagaccattttaaaagcattgggaccaggggctacactagaggaaatgatgacagcatgtcagggagtgggaggacctagccataaggcaagagttttggctgaggcaatgagccaagcaacaaatacagctataatgatgcagaaaagtaactttaagggccaaagaagaattgttaaatgctttaattgtggcaaagaaggacacatagccaaaaattgcagggcccctagaaaaaagggctgttggaagtgtggaagagagggacaccaaatgaaggactgcactgagagacaggctaattttttagggaaaatttggccttccaacaaggggaggcccggaaacttcatccagaacaggccagagccgtcagccccgccagcagagagcttcaggttcggggaggagacaaccccatctccgaagcaggagcagaaagacgagggactgtaccctcccttagcttccctcaaatcactctttggcaacgacccctagtcacaataagagtagggggacagctaaaggaagctctattagatacaggagcagatgatacagtattagaagacgtaaatttgccaggaaaatggaaaccaaaaatgatagggggaattggaggttttatcaaagtaaaacagtatgatagcatactcatagaaatttgtggacacagagctataggtacagtgttagtaggacctacgcctgtcaacataattggaagaaatatgttgacccagattggttgtactttacattttccaattagtcctattgagactgtaccagtaaaattgaagccaggaatggatggcccaaaggttaaacaatggccattgacagaagaaaaaataaaagcattaacagaaatatgtatggaaatggaaaaggaaggaaaaatttcaaaaattgggcctgaaaatccatacaatactccagtatttgccataaagaaaaaagacagtactaaatggaggaaattagtagatttcagagaacttaataaaagaactcaagatttttgggaggttcaattaggaataccgcatccagcagggttaaaaaagaaaaagtcagtaacagtactggatgtgggggatgcatatttttcagttcccttagataaggatttcaggaagtacactgcatccaccatacctagtaccaacaatgagacaccaggagttaggtaccagtacaatgtgcttccacaaggatggaaaggatcaccagcaatattccaatatagcatgacaaaaatcttagatccctttagagcaaaaaatccagacatagttatctaccaatacatggatgatttgtatgtagggtctgacttagaaataggacagcatagaacaaaaatagaagagttaagagaacatctactgaaatggggattaactacaccagacaaaaaacatcaaaaagaacccccattcctttggatggggtatgaactccatcctgataaatggacagtgcagcctatacaattgccagacaaggacagctggactgtcaatgatatacagaagttagtaggaaaactaaattgggcaagtcagatttatccagggattaaagtaaaacaattatgtaaactccttaggggagccaaggcactaacagacatagtgccactgactacagaagcagagttagaattggcagagaatagggagattctaaaagaaccagtacatggggcatattatgacccgtcaaaagacttaatagcagaaatacagaaacaagggcaagggcaatggacatatcaaatttatcaagagccatttaaaaatctaaaaacaggaaagtatgcaaaaatgaggtctgcccacactaatgatgtaaaacagttaacagaagcagtgcaaaagatatctctagaaagcatagtaatatggggcaagactcctaagtttagactacccatattaaaagagacatgggatacatggtggacagagtactggcaagccacctggattcctgagtgggagtttgtcaataccccccctctagtaaaactatggtatcagttagaaacagagcccatagtaggagcagaaaccttctatgtagatggggcatctaatagagagaccaaaaaaggaaaagcaggatatgttactgacagaggaagacaaaaagcggtctccctaactgagactacaaatcagaaggctgagttacaagcaattcagttagctttacaggattcaggatcagaagtaaacatagtaacagactcacagtatgcattaggaatcattcaagcacaaccagataagagtgaatcagagttagtcaatcaaataatagagcaattaataaaaaaggaaaaggtctacctgtcatgggtaccagcacacaaagggattggaggaaatgaacaagtagataaattagtcagtgctggaatcaggaaagtactgtttctagatgggatagataaggcacaagaggaacatgaaaaatatcacaacaattggagagcaatggctagtgattttaatataccagctgtagtagcaaaagaaatagtagctagctgtgataaatgtcagctaaaaggggaagccatgcatggacaagtagattgtagcccagggatatggcaattagattgcacacatttagaaggaaaaattatcctggtagcagtccatgtagctagtgggtacctagaagcagaagttatcccagcagaaacaggacaagagacagcctacttcctactaaagttagcaggaagatggccagtaaaaacaatacatacagacaatggcaccaatttcaccagtgccacggttaaggcagcttgttggtgggcaggtatccagcaggaatttggaattccttacaacccccaaagtcaaggagtagtagaatctatgaataaagagctaaagaaaatcataggacagataagagatcaagctgaacatcttaagacagcagtccaaatggcagtattcattcacaattttaaaagaaaaggggggattgggggatacagtgcaggggaaagaacaatagacataatagcaacagacatacaaactagagaattacaaaaacaaattataaaaattcaaaatttccgggtttattacagggacagcagagacccagtttggaaaggaccagcaaagctactctggaaaggtgaaggggcagtagtcatacaagacaatagtgaaataaaggtagttccaagaagaaaagcaaagatcattagggattatggaaaacagatggcaggtgatgattgtgtggcaggtagacaggatgaggattaacacatggaaaagtttagtaaaataccatatgcatatttcaaagaaagccaaaggatggttttatagacatcactttgaaagcaggcatccaaaaataagttcagaagtacacatcccactagagacagctgaattagtaataacaacatactgggggctgcttccaggagaaagagaatggcatctgggtcagggagtctccatagaatggaggcaggggaggtatagaacacaaatagaccctggcctggcagaccaactgatccatatatattattttgattgtttttcagaatctgccataaggaaagccatattaggacataaaattagccctaggtgtaactatcaagcaggacataacaaggtaggatctctacaatacttggcactaacagcattaatagctccaaaaaagacaaagccgcctttgcctagtgtccagaaactagtagaagacagatggaacaagccccagaagaccaggggccacagagagagccatacaatgaatggacactagatcttttagaggagcttaagaatgaagctgttagacattttcctaggccatggctccatagcttaggacaacatatctataacacctatggggatacttgggaaggagttgaagcaatcataaggatattgcaacaactactgtttatccatttcagaattgggtgccgtcatagcagaataggcattactcgacagagaagagtaagaaatggaactagtagatcctaacttagatccctggaaccatccaggaagccagcctacaactccttgtaccagatgttattgtaaatggtgttgctttcattgttactggtgctttacaacgaagggcttaggcatctcctatggcaggaagaagcggagacagcgaccaagaactcctcaaagcagtcagatacatcaagattttgtaccaaagcagtaagtattgttaagcatatgtaatgtcaaatttgttagcaataggcatagcagcattaatagtagcactaataataacaatagttgtgtggactatagcatatatagaatataagaaactggtaaggcaaagaaaaataaataggttatataaaagaataagcgaaagagcagaagacagtggcaatgagagtgagggggatgcagaggaattggcagcacttggggaagtggggccttttattcctggggacattaataatctgtaatgctgcagaaaacttatgggttacagtctattatggggtacctgtgtggaaagaagcaaccactactctattctgtgcatcagatgctaaatcatatgaaaaagaggcacataatgtctgggctacacatgcttgtgtacccacagatcccaatccacaagaagtagttctggaaaatgtaacagaaaggtttaatatgtgggaaaataacatggtagaacaaatgcatacagatataatcagtttatgggatcaaagcctaaagccatgtgtgaagttaaccccactctgtgttactttagattgtagaaacattgccaccaatggcaccaatgacactattgccatcaatgacactctgaaggaagatccagaggcaatacaaaactgttctttcaatacaaccacagaaataagagataagcagctgaaagtacatgcacttttttataaacttgatatagtacaaatcaacaaggatgacaatagaacatacagactaataaattgtgatgcctcaaccattacacaggcttgtccaaaggtatcttgggatccaattcccatacattattgtgctccagctggttatgcgattctaaagtgtaatgagaaaaatttcacagggacagggtcatgcaagaatgtcagtacagtacaatgtacacatggaattaaaccagtggtatccactcaattgttgttaaatggcagcctagcagaaggagagatagtaatcagatctcaaaatatctcagataatgcaaaaaccataatagtgcaccttaatgaatctgtacagattaattgtacaagacccaacaacaatacaagaaaaagaatatctttaggaccaggacgagtattttatacaacaggagaaataataggagacatcagaaaggcacattgtaacgttagtggaacacaatggaggaacacgttagcaaaggtaaaggcaaagttagggtcttatttccctaatgcaacaataaaatttaactcatcctcaggaggggacctagaaattacaaggcataattttaattgtatgggagaatttttctactgtaatacagatgaactgtttaatgacacaaaattcaatgacacaggattcaatggcactatcactctcccatgtcgaataaaacaaattgtaaacatgtggcaggaagtgggacgagcaatgtatgccaatcccattgcaggaaacattacctgtaactcaaatattacaggtctgctattgacaagagatggtggtctgaatagtactaatgagaccttcagacctgggggaggaaatatgaaagacaattggagaagtgaattatataaatataaagtagtagaaattgaaccactaggagtagcacccaccaaggcaaaaagacaagtggtgaagagagaaagaagagcagtgggactaggagctctgttccttgggttcttgggagcagctggaagcactatgggcgcggcgtcaataacgctgacggtacaggccagacaattattgtctggaatagtgcaacagcagagcaatctgctgagggctattgaagcgcaacagcatctgttgcagctcacagtctggggcattaaacagctccaggcaagagtcctggctgtggaaagatacctaaaggatcaacagctcctagggctttggggctgctctggaaaactcatctgcaccactaatgtgccctggaactctagttggagtaataaatctcttgaggagatttgggggaacatgacctggatggagtgggaaaaagaggttagcaattactcaaaagaaatatacaggttaattgaagactcgcagaaccagcaggaaaagaatgaacaagaattattagcattggacaaatgggcaagtctgtggaattggtttgacataacacagtggctgtggtatataaaaatattcataatgatagtaggaggcttgataggcttaagaatagtttttactgtgctttctatagtaaatagagttaggaagggatactcacctttgtcatttcagacccatatcccaagcccgagggaacccgacaggcccgaaggaatcgaagaaggaggtggagagcaaggcaaagacagatccgtgagattagtgaccggattcttagctcttgcctgggacgacctgcggaacctgtgcctcttcagctaccgccacttgagagacttcatattaattgcagcgaggattgtggacagggggctgaagagggggtgggaagctctcaaatatctggggaatctcacacagtattggggtcaggaactaaagaatagtgctattagcttgcttaatgccacagcaatagcagtagctgagtggacagatagagttatagaagctttgcaaagagctggtagagctattctcaacatacctagaagaataagacagggcttggaaagggctttgctataaaatgggtggcaagtggtcaaaaagtagtatagttggatggcctgctataagggaaagaatgaggcgaacccctccaacccctccagcagcagagggggtgggagcagtgtctcaagacttagaaagacggggggcaattacaagcagcaatactagagctaataatcctgacttggcctggctggaagcacaagaggaagacgaagtaggctttccagtcagacctcaggtacctttaagaccaatgacctataagggagctgtagatctcagtcactttttaaaagaaaaggggggactggaagggttaatttactccaagagaagacaagagatccttgatctgtgggtctaccacacacaaggctacttccctgattggcagaactacacaccagggccagggatcagatatccactgaccatggggtggtgcttcaagctagtaccagttgacccagaggaggtagaaaaggccaatgaaggagagaacaactgcttgctacaccccatgagccaacatggaatggaggatgaagacaaagaagtactgaaatgggagtttgacagccgcttggcactgagacacatagccagagagagacatccggagtactaccaagactgagactgctgacacagagattgctgacacagaagaatctaaagggactttccactggggactttccagagggtgggccagagggcgggactggggagtggctcaccctcagatgctgcatataagcagccgcttttcgcctgtactgggtctctctagttagaccagatttgagcccgggagctctctggctagctagggaacccactgcttaagcctcaataaagcttgccttgagtgcttt

SEQ ID NO: 2 - DNA, 8987 bp, Human immunodeficiency virus type 1
  isolate=92NG083; 156.362:gag; 1727.4465:pol; 4410.4988:vif; 4928.5218:vpr; 5199.7795:tat; 5338.8000:rev; 5440.5466:vpu; 5593.8142:env; 8144.8767:nef
atgaaagcgaaagttaatagggactcgaaaacgaaagttccagagaagttctctcgacgcaggactcggcttgctgaagtgcacacagcaagaggcgagagcggcgactggtgagtacgccattttttgactagcggagggctagaaggagagaggtgggtgcgagagcgtcagtattaagcgggggaaaattagattcttgggaaaaaattcggttaaggccagggggaaggaaaaagtataaactaaaacatatagtatgggcaagcagggaactggggagatttgcacttaaccgtgaccttttagaaacagcagaaggttgtgtgcaaataatgaaacagttgcaaccagctctctagacaggaacagaggagcttagatcattatttaatacagtagcaaccctctactgtgtacatcaaaagatagaggtaaaagacaccaaagaagctccagaggaagtggaaaaaatacaaaagaacagtcagcaagaaatacagcaggcagcaaagaatgaaggaaacagtaacccagtcagccaaaattatcctatagtgcagaatgcacaagggcaaatgatacatcaggccatatcacctaggactttgaatgcgtgggtaaaagtagtagaagaaaaggccttcagtccagaagtaatacccatgttttcagcattatcagagggagccaccccacaagatttaaataccatgctaaatacagtgggggggcatcaagcagctatgcaaatgctaaaggatactatcaatgatgaagctgcagagtgggacaggatacatccacagcaggcagggcctattccaccaggccaaataagagagcctagtggaagtgatatagcaggaactactagtaccctgcaggaacaaataagatggatgaccagcaacccacctatcccagtgggagaaatctataaaagatggataatcctgggattaaataaaatagtgagaatgtatagccctgtcagcattttggacataagacaagggccaaaagaaccctttagagattatgtagataggttctttaaaactttgagagctgagcaagctacacaggaagtaaaaggttggatgacagacaccttgttggttcaaaatgcgaacccagattgtaaaaccatcttaagagcattaggaccaggagctacactagaagaaatgatgacagcatgtcagggagtgggaggacccagccataaagcaagagttttagctgaggcaatgagccaggcatcaggtgcagcagcagcagccataatgatgcagaaaagcaattttaagggcccgagaagaattattaagtgtttcaactgtggcaaggaaggacatctagccagaaattgcagggcccctaggaaaaagggctgttggaaatgtggaaaggagggacatcaaatgaaagaatgcacggaaaggcaggctaattttttagggaaaatttggccttccaacaaggggaggccaggaaactttctccagaacaggacagagccaacagccccaccagcagagagcttcggattcggagaggagatagccccctccccgaagcaggagccaaaggagaaggagctatatcccttaacttccctcaaatcactctttggcagcgacccctagtcacagtaaaaatagggggacagctaatagaagccctattagacacaggagcagatgacacagtattagaaggaataaatttaccaggaaaatggaaaccaaaaatgatagggggaattggaggttttatcaaagtaagacagtatgatcaaatacttatagaaattggtggaaaaaaggctatagggacagtattagtaggacctacacctattaacataattgggagaaatatgttgactcagattggttgtactttaaactttccaataagtcctattgaaactgtaccagtaaaattaaagccaggaatggatggcccaagggttaaacaatggccattgacagaagagaaaataaaagcattaacagaaatttgtaaagacatggaaaaggaaggaaaaatttcaaaaattgggcctgaaaatccatataacactccaatattcgccataaagaaaaaagacagtactaaatggagaaaattggtagatttcagagaacttaataaaagaactcaagacttctgggaggtccaattaggaatacctcaccccgcggggttaaaaaagaaaagatcagtaacggtactagatgtgggagatgcatacttttcagttcccttagataaagactttagaaagtatactgcatttactatacctagtataaataatgagacaccagggattagatatcaatacaatgtgcttccacagggatggaaaggatcaccagcaatatttcagagtagcatgacaaaaattttagagccttctagaacaaaaaatccagaaatggtgatctaccaatacatggatgatttatatgtaggatctgacttagaaatagggcagcatagagcaaaaatagaggagttaagagaacatctactgaaatggggattgaccacaccagataaaaaacatcagaaagaacctccattcctttggatgggatatgagctccatcctgacaaatggacggtacaacctatacagctgccagaaaaggaagattggactgtcaatgatatacaaaagttagtgggaaaactaaattgggcaagtcagatttatccagggattaaagtaaagcacctatgtagactccttaggggggccaaagcactaacagacatagtacccctaacggcagaagcagaaatggagctggcagagaacagggaaattctaaaagaacctgtacatggagtctatcatgacccatcaaaagaattaatagcagaagtacagaagcaagggccagaccaatggacatatcaaatttatcaagagccatacaaaaatctaaaaacaggaaaatatgcaaaaagggggtctgcccacactaatgatgtaaaacaattaacagaagtagtgcaaaaaatagccacagagggcatagtaatctggggaaagattcctaaatttaaactacctatacgaaaagaaacatgggaagtatggtggacagagtactggcaggccgcctggattcctgagtgggagtttgtcaatacccctcctctagtaaaactatggtatcaattagaaacagaacccataccaggagcagaaacttactatgtagatggggcagctaatagggagacaaaattaggaaaggcaggacatgttactgacaaaggaaaacaaaaaattattaccctaactgaaacaacaaaccaaaaggctgaattacatgcaattcaactagctttgcaggactcaagaccagaagtaaacatagtaacagactcacagtatgcattaggaatcattcaagcacaaccagataggagtggatcagaattagtcaatcaaataatagaacagctaataaaaaaggaaaaggtctacctgtcatgggtaccagcacacaaagggattggaggaaatgaacaagtagataagctagtcagtagtggaatcaggaaagtattatttttggatggcatagataaagcccaagaagaacatgaaagatatcacagcaattggagagcaatggctagtgattttaatctgccacctgtagtagcaaaagaaatagtggccagctgtgataaatgtcaactaaaaggggaagccatgcatggacaagtagactgtagtccaggaatatggcaattagattgtacacatttagaaggaaaaattatcatagtagcagttcatgtagccagtggctatatagaagcagaagttatcccagcagaaacagggcaggaaacagcatactttatattaaaattagcaggaaggtggccagtaaaagtgatacatacagacaatggtcccaatttcatcagtgctgcagtaaaggcagcatgttggtgggcaaatatcacacaggaatttggaattccctacaatccccaaagccaaggagtagtggaatctatgaataaggaattaaagaaaatcatcggacaggttggagatcaagctgaacatcttaagacagcagtacagatggcagtattcattcacaattttaaaagaaaaggggggattggggggtacagtgcaggggaaagaataatagacataatagcatcagatatacaaactaaagaactacaaaaacaaattataaaaattcaaaattttcgggtttattacagggacagcagagacccaatttggaaaggaccagcaaagctactctggaaaggtgaaggggcagtagtaatacaggacaataacgaaataaaggtagtaccaagaagaaaagcaaagatccttaaggattatggaaaacagatggcaggtggtgattgtgtggcaggtagacaggatgaggattagaacatggaacagtttagtaaaacatcatatgtatgtctcaaagaaagctaaaggctggttttatagacatcactatgaaagcaggcatccaagagtaagttcagaagtacacatcccactaagagatgctacactagtagtaagaacatattggggtctgcatgcaggagaaaaagactggcaattgggccatggggtttccatagaatggaggcagaaaagatatagtacacaaatagaccctaacacagcagaccatctgattcatctgtattattttgactgtttttcagaatctgccataagaaaagccatattaggagagatagttagccctaggtgtgaatacccagcaggacataataaggtaggatctctacaatatctggcatcgaaagcattagtaacaccaacaaggaaaaggccacctttgccaagtgttgggaaattagcagaagatagatggaacaagccccagaagaccagggaccacagagagaaccctacaatgaatggacattagaactgttagaagagcttaaaaatgaagctgttagacattttcctaggccctggctccatggcttaggacagtatatctataacacttatggggatacttgggaaggagttgaagccataataagaatactacaacaactactgtttatccatttcagaatcgggtgccaacatagcagaataggcattactccacagagaagagtaagggatggacccggtagaccctaagctagagccctggaatcatccggggagtcagcctacaactccctgtaacaaatgttattgtaaagtgtgctgctggcattgtcaagtttgctttttaaacaaaggcttaggcatctcctatggcaggaagaagcggagaccccgacgaggaactcctcagggcagtaaggatcatcaaaaccctgtaccaaagcagtaagtagtaacaattaatatatgtaatgcaggccttagaaatatctgactaatagtagcattcatagcagccacaattgtgtggagtatagtatttatagaatatagaaaaataagaaaacagaaaaaaatagaaaagttacttgatagaataagagaaagagcagaagacagtggaaatgagagtgaaggggatacagaggaattggcaacacttatggaaatgggggactttgatccttgggttggtaataatttgtagtgcctcagataacttgtgggtcacagtctattatggggtacctgtgtgggaagatgcagatacccccctattctgtgcctctgatgctaaatcatatagttctgaaaaacataatgtctgggctacacatgcctgtgtacccacagaccctaacccacaagaaatagctatagaaaatgtaacagaaaattttaacatgtggaagaataacatggtagaacagatgcaggaggatataatcagtttatgggaggaaagcctaaagccatgtgtaaagctaactcctctctgtatcactttaaactgtactaatgtaaacagtgctaatcatactgaggccaataacactgtagaaaacaaagaagaaataaaaaactgctctttcaagataaccacagaaaggggaggcaagaagaaggaagaatacgcgcttttctataaacttgatgtggtaccaattagtaatgggaataagactagttataggctaatacattgtaatgtctcaaccattaaacaggcttgtccaaaggtaaattttgacccaattcccatacattattgtgctccagctggttttgcgattttaaagtgtagggataaggagtacaatggaacaggaccatgtaaaaatgtcagtacagtacaatgtacacatggaattaagccagtggtatcaactcaactactgctgaatggcagtttagcagaagaagatataagaattagatctgaaaatttcacagacaataccaaagtcataatagtgcagcttaataatagtatagaaattaattgtatcagacccaataacaatacaagaaaaagtataccaatcggaccaggacaagcgttctatgcaacaggtgatataataggagacataagacaagcacattgtaatgttagtagaataaaatggagggagatgttaaagaatgtcacagcacagctaaggaaaatctataataataagaacataacctttaactcatctgcaggaggggacctagaaattacaacacatagtttcaattgtagaggagagtttttctattgcaatacatcaggactgtttaataataatattagtaatattaataatgagactatcacactcccatgtaaaataaaacaaattgtgaggatgtggcagaaagtgggacaagcaatgtatgcccttcccatcgcaggaaaccttgtatgtaaatcaaacattacaggattaatattaacaagagatggtgggaataacaatgacagtacagaggagaccttcagacctggaggaggagatatgagggacaattggagaagtgaattatataagtataaaacagtaaaaatcaaatcactaggagtagcacccaccagggcaaggagaagagtggtggagagagaaaaaagagcagttggactgggagctgtcttccttgggttcttaggagcagcagggagcactatgggcgcggcgtcaataacgctgacggcacaggtcagacaattattgtctggcatagtgcaacagcaaagcaatttgctgagggctatagaggcgcagcagcatctgttgcaactcacagtctggggcattaaacagctccagtcaagagtcctggctatagaaagatacctaaaggatcaacagctcctagggatttggggctgctctggaaaactcatctgcaccactaatgtgccctggaacactagttggagtaataaatcttataatgagatttgggataacatgacttggctagaatgggaaagggaaattcacaattacacacaacacatatacagcctgattgaagaatcgcagaaccagcaggaaaagaatgaacaagacttattggcattggacaagtgggcaagtttgtggaattggtttgacatatcaaattggctatggtatataagaatattcataatgatagtaggaggtttaataggtttaagaatagtttttgctgtgctttctatagtaaatagagttaggcagggatactcacctttgtcgttccagacccttacccatcaccagcgggaacccgacaggctcggaaaaaccgaagaaggaggtggcgagcaagacagagacagatccactcgattagtgagcggattcttagcgcttgcctgggacgacctgcggagcctgtgccttttcagctaccaccgcttgagggacttagtcttgattgcagcaaggacggtggaacttctgggacgcagcagcctcaagggactgagactggggtgggaaggcctcaagtacttgtggaacctcctgttgtattggggtcgggaactaaagaatagtgctattaatttgcttgatacaatagcaatagcaacagctaacgggacagatagggttatagaagtagcacaaagagcttatagagctattctcaacgtacctacaaggataagacaaggcttagaaagagctttgctataaaatggggggcaagtggtcaaaaagtagcatagttggatggcctcagataagggaaagaataagacaaactcctgtagcagcagaaggagtaggagcagtatctcaagatttagctaggcatggagcaatcacaagcagcaatacagcaaccaacaatcctgattgtgcctggctggaagcacaagaggaggactcagatgtaggctttccggtcagaccacaggtacctttgagaccaatgacttataaggctgcttttgatctcagcttctttttaaaagaaaaggggggactggatgggctaatttactccaagagaagacaagacatccttgatctatgggtctataatacacaaggattcttcccagattggcagaactacacaccagggccagggactagactcccactgacctttgggtggtgcttcaaactagtaccaatggacccagcagagatagaggaagccaataagggagagaacatcagtctattacaccccatctgccagcatggaatggaggatgaagacagagaagtgctggtatggagatttaacagtagcctagcacggagacacctagcccgagagctgcatccggagtactacaaagactgctgacacagaagttgctgacaagggactttccgcctgggactttccaggagaggcgcggcctgggaggggctggggagtggctaaccctcagaagctgcatataagcagccgcttctcgcctgtactgggtctctcttgttggaccagatttgagcctgggagctctctggttggcaggggaacccactgcttaagcctcaataaagcttgccttgagtgcttc

SEQ ID NO: 3 - DNA, 8953 bp, Human immunodeficiency virus type 1
  isolate="90CR056"; 137..1639:gene="gag"; 4388..4966:gene"vif"; 4906..5196:gene "vpr"; 5177..7782:gene="tat"; 5316..7972:gene="rev"; 5408..5650:gene="vpu"; 5577..8114:gene="env"; 8117..8737:gene="nef"
ttgatagtgaaagtaaaaccagagaagatctctcgacgcaggactcggcttgctgaagtgcacacagcaagaggcgagagcggcgactggtgagtacgccattttgttttgactagcggaggctagaaggagagagatgggtgcgagagcgtcagtattaagcggcggaaaattagatgcttgggagaaaattcggctaaggccagggggaaagaaaaaatataggctaaaacatctagtatgggcaagcagggagctggaaagatttgcacttaaccccggccttttagaaacaccagaaggctgtctacagataatagaacagatacagccagctattaagacaggaacagaagaacttaaatcattatttaatctagtagcagtcctctattgcgtacatcgaaaaatagatgtgaaagacaccaaggaggctttagataagatagaggaaatacaaaacaaaagtcagcaaaaaacacagcaagcagcagctgataaggaaaaagacaacaaggtcagtcaaaattatcctatagtacagaatgctcaagggcagatggtacaccaggccatatcacctaggaccttaaatgcatgggtaaaagtagtagaagaaaaggcttttagcccagaagtaatacccatgttttcagcattatcagaaggagccaccccacaagacttaaatgctatgctaaatacagtggggggacatcaagcagccatgcagatgttaaaagatacaatcaatgaggaagctgcagaatgggacagggtacatccagtgcatgcagggcctattccaccaggccaaatgagagaaccaaggggaagcgatatagcaggaactactagtaccctgcaggaacaaatagcatggatgacaggcaatccagctatcccagtgggagacatctataaaagatggataatcctgggattaaataagatagtaagaatgtatagtcctgtcagcattctggacataaaacaagggccaaaagaaccctttagagactatgtagacaggttttttaaaactttaagagctgagcaagccacacaggatgtgaagaattggatgacagaaaccttgttggtccaaaatgcaaatccagattgcaagactatattaagagcattaggacaaggggcttcaatagaagaaatgatgacagcatgtcagggagtgggaggacctagtcataaagcaagagttttggctgaggcaatgagccaagtaacaaatacaaatacagccataatgatgcagaaaggcaactttaagggccaaagaaaatttgttaaatgcttcaactgtggcaaagagggacacatagccagaaattgcagggcccctaggaaaaagggctgttggaaatgtggaagagaaggacatcagatgaaagactgcacagagagacaggctaattttttagggaaaatttggccttccagcaaagggaggccaggaaattttctccagagcaggccagaaccaacagccccaccagcagagagcttcgggttcggagaggagatgaccccctctccgaagcaggagcagctgaaggacaaggaacctcccttagcttccctcagatcactctttggcagcgaccccttgttacagtaaaaatagagggacagttaagggaagctctattagatacaggagcagatgatacagtattagaagagataaatttgccgggaaaatggaaaccaaaaatgatagggggaattggaggttttatcaaagtaagacagtatgagcaagtagccatagaaatctgtggaaaaaaggctataggtacagtattagtaggacctacacctgtcaatataattggaaggaatatattgactcaaattggttgcaccttaaattttccaattagtcctattgaaactgtaccagtaaaattaaagccaggaatggatggcccaaaggttaaacaatggccattgacagaagaaaaaataaaagcattaacggaaatttgtacagagatggaaaaagaaggaaaaatctcaagaatagggcctgagaatccatacagcactccaatatttgccataaaaaagaaggatagtactaaatggagaaaattagtggatttcagagaactcaataaaagaactcaagacttctgggaagttcagttaggaataccacacccagcagggttaaaaaagaaaaaatcagtatcagtactggatgtgggggatgcatatttttcagtccctttagataaagaattcagaaagtatactgcattcaccatacctagtataaacaatgagacaccagggattagatatcagtataatgtgcttccacagggatggaaaggatcaccagcaatattccagagtagcatgacaaaaatcttagcgccctttagagaacaaaatcctgaaatggttatttaccaatacatggatgatttgtatgtaggatctgacttagaaatagggcaacatagagcaaaaatagaggagttaagagctcatttgttgaaatggggatttaccacaccagacaaaaaacatcagaaagaacccccatttctttggatgggatatgaactccatcctgacaaatggacagtacagactgtaaaactgccagaaaaagacagctggactgtcaatgatatacagaagttagtgggaaaactaaattgggcaagtcagatttatccaaatattaaagtaaagcaactatgtaaactccttaggggggccaaagcattaacagacataataccactgacaaaagaggcagaattggaattggcagaaaacagggagattctgagagaaccaatacatggagtatattatgatccatcaaaagacttaatagcagaaatacggaagcaagggcaaggccaatggacatatcaaatttatcaggagccatttaaaaatctgaagacaggaaaatatgcaaaaatgagaactgcccacactaatgatataaaacaattaacagaagcagtgcaaaagatatctacagaaagcatagtaatatggggaaaaattcctaaatttagactacctatacaaaaagaaacatgggagacctggtggacagagtattggcaagccacatggattcctgaatgggagtttgttaacacccctcatctagtaaaattatggtatcagttagaaacagagcccatagcaggagcagaaacttactatatagatggggcagctaatagggaaactaaattaggaaaagcaggatatgtcactgatagaggaaagcaaaaagttgtctccctaacggaaacaacaaatcagaagactgaattacaagcaatttatctagctttgcaagattcagggttagaagtgaacatagtgacagattcacagtatgcactaggaatcattcaagcacaacccgataagagtgaatcagagttagttaatcaaataatagaggaattaataaagaaggaaaaggtctacctgtcatgggtaccagcacacaaaggaattggaggaaatgaacaagtagataaattagttagttctggagtcagaaaagtgctatttctagatgggatagataaagctcaagaagaacatgaaaggtatcataacaattggagagcagtggctagtgattttaatctaccacctatagtagcaaaagaaatagtagctagctgtgataaatgtcagctaaaaggggaagccatgcatggacaagtagactgtagcccaggaatatggcaattagattgcacacatttggaaggacaagttattctggtagcagtccatgtagccagtggctatatagaagcagaagtcatcccagcagaaacaggaaaggaaacagcatacttcctgttgaaactagcaagcagatggccagtaaaagtaatacatacagacaatggcagcaatttcacgagtgctgcggttaaggcagcctgttggtgggcagatatccaacaggaatttgggattccctacaatccccaaagtcagggagtagtagaatctatgaataaagaattaaagaagatcatagggcaggtaagagaccaagcagaacaccttaagacagcagtacaaatggcagtattcattcacaattttaaaagaaaaggggggattggggggtacagtgcaggggaaagaataatagacataatagcaacagacatacaaactaaagaattacaaaaacaaatttcaaacattcaaaaatttcgggtttattacagggacagcagagacccaatttggaaaggaccagcaaaactcctctggaaaggtgaaggggcagtagtaatacaagacaatagtgaaataaaagtagtaccaagaagagaggcaaaaatcattagggattatggaaaacagatggcaggtgatgattgtgtggcaagtagacaggatgaggattaacacatggaaaagcttagtaaagtaccatatgcatatttcaaggaaagctagaggatggttttatagacatcattttgaaagcactcatccaaggataagttcagaagtacacatcccattaggagaagctaggttagtcataaccacatactggggtctgaatacaggagaaagagaatggcatttaggccagggagtctccatagaatggagactgaaaaggtatagcacacaagtagagcctggcctggcagaccaactaattcatatgcattattttgattgtttttcagaatctgccataaggaaagccatattaggacgtgtagttagacctaggtgtaactatccagcaggacataaacaggtaggaactctacaatacttggcattaacagcattagtggcaccaaaaaagataaagccacctttgcctagtgttagaaagctagtagaggatagatggaacaagccccagaagaccaggggccacagagggagccacacaatgaatggacactagagcttttagaggagattaagaatgaggctgttaggcattttcctagagtatggctccatcaattaggacagcatatctataacacctatggagatacttgggtaggagttgaagctttaataagaacgctgcaacaactactgtttattcatttcagaattgggtgccaacatagcagaataggaattactcgacagagaagagtaagaaatggacccagtagatcctaaactagagccctggaaccatccaggaagtcagcctcaaactgcttgtaacaattgttattgtaaaaagtgctgctatcattgccaaatgtgctttttaaagaaaggcttaggaatttcctatggcaggaagaagcggagccagcgacacagaactcctgcaagtttgcaagatcatcaaaattctatatcaaagcagtaagtattatcataaatgtatatattaggattaggaataggagcgctagtagtaacatttatcatagccgtaattgtgtggaccatagtatatatagaatataaaaaattggtaaggcaaaagaaaatagacaggctaattgaaagaataggagaaagagcagaagacagtggcaacgagagtgatggagacacagaggaattatccaagcttatggagatggggcaccttaatcttgggtatgttgctgatctgtagtgctgcacaaaacttgtgggttacagtatattatggggtacctgtgtggaaagaggcaaaaaccactctattctgtgcatcagatgctaaggcatatgagacagaaaagcataatgtctgggctacacatgcatgtgtacccacagaccccaacccacaagagatggtcatggagaatgtaacagagagctttaatatgtgggaaaataacatggtggagcagatgcatacagacataatcagtttatgggatcaaagcttgaaaccatgtgtaaaattaaccccactctgtgttactctaaactgtactaatgtcagaaacaatacctctaacagcactagcagtatggaggcaggaggggaactaacaaattgctctttcaatgtaactacagtactaagagataagcagcagaaagtacatgcactcttttatagacttgatgtagtaccaattgataacaatagtactcagtataggctaataaattgtaatacctcagtcattacacaggcttgcccaaaggtgtcctttgaacctattcccatacattattgtgctccagctggctttgcgattctaaagtgtaacaataaaacattcaatggaacaggattatgtacaaatgtcagtacagtacaatgtacacatggaattagaccagtggtatcaactcaactgctattaaatggaagcctagcagaagaacagatcataattagaactaaaaatatctcagacaataccaaaaacataatagtacagcttaagacaccagtaaacattacatgtaccaggcctaacaataatacgagaacaagtatacatttagggccaggacgagcattctatgcaacaggtgacatcataggagatataagacaagcacattgtaatattagtagaacagactggaataagactttacaccaggtagttacacaattaggaatacacttgaacaatagaacaataagctttaagccaaactcaggaggggacatggaagttagaacacatagttttaattgtagaggagaatttttctattgcaatacatcagggctgtttaatagtagttgggaaatgcatactaattacacatcaaatgacacaaagggaaacgaaaacattacactgccatgcagaataaaacaaattgtaaacatgtggcagagagtaggacgagcaatgtatgcccctcccatccaaggaaacattatgtgtgtatcaaatattacaggactaatattgacaattgacgagggtaacgcgtctgcagaaaattataccttcagacctggaggaggagatatgagggacaattggagaagtgaattgtataaatataaagtagtaaaaattgaaccactgggaatagcacccaccaagacaaggagaagagtggtggagagagaaaaaagagcagtgggaatgggagcttctttccttgggttcttgggagcagcaggaagcactatgggcgcggcgtcaataacgctgacggtacaggccaggcaattattgtctggtatagtgcagcagcaaagcaatttgctgagagctatacaggcgcgacagcatatgttgcagctcacggtctggggcattaaacagctccaggcaagagtcctcgctgtggaaagatacctaagggatcaacagctcctggggatttggggctgctctggaaaactcatctgcaccactaatgtgccttggaactctagttggagtaataaatcacagagtgaaatctgggacaacatgacttggatggaatgggataaacaaattagcaattacacagaggaaatatacaggttgcttgaagtctcgcaaacccagcaggaaaagaatgaacaggacttattagcattggacaaatgggcaagtctgtggacttggtttgacatatcacattggctgtggtatataaaaatattcataatgatagtaggaggtttaataggtttaagaataatttttgctgtgctttctatagtaaatagagttaggcagggatactcacctttgtcttttcagacccttgtcccgaacccacggggacccgacaggcccgaaggaacagaagaaggaggtggcgagcaagacagagacagatccgtgagattagtgaacggattcttaccagttgtctgggacgacctccggagcctgtcactcttcagctaccgcctcttgagagacttactcttaattgtagtgaggactgtggaacttctggggagaagggggagggaagccctcaaatatctctggaatcttctacaatactggggacaggaactaaagaatagtgctattgatttgcttaacaccacagcaatagcagtagctgagggaacagatgggattatagtaatagtgcaaagagcttggagagctattctccacatacctagaagaataagacagggctttgaaagaagcttgctataataatgggaggcaaatggtcaaaaagtaggatgggtgggtggtctactataagggaaagaatgaggcgagctgaaccagtagcagaaggggtaggagcagtgtctcgagatttggatagacgcggggcagtcacaattaataatacagcatctactaatcgtgatgccgcctggctggaagcacaagaggacggggaggaagtaggctttccagtcaggcctcaggtacctttaagaccaatgacctataagggagcttttgatctcagccattttttaaaagaaaaggggggactggatgggttaatttactccaagcaaagacaggacatccttgatttatgggtctataacacacaaggctacttccctgactggcagaactacacaccagggccaggggagagatttcccctgacctttgggtggtgcttcaagctagtaccagtaaatccacaggaggtagaacaggccaatgaaggagagaacaacagcttgctacaccccatgagcctgcatggaatggaggatgacgggagagaagtgctgatgtggaaatttgacagtcgactagcattgacacacttggcccgagtaaagcatccggagtacaaagactgctgacacagaagatctgaaagggactttccgctgggactttccggggaggcgtgatctgggcggggatggggagtggccaaccctcagatgctgcatataagcagctgcttttcgcttgtactgggtctctttggttagaccagatctgagcctgggagctctctggctagctaaggaacccactgcttaagcctcaataaagcttgccttgagtgcttt

SEQ ID NO: 4 - DNA, 8992 bp, Human immunodeficiency virus type 1
  isolate=92RW009; 139.1624:gag; 1690.4428:pol(N-terminus uncertain); 4373.4951:vif; 4891.5181:vpr; 5162.7801:tat; 5301.7958:rev; 5403.5648:vpu; 5566.8148:env; 8150.8773:nef
atgaaagcgaaagtaagaccagaggagatctctcgacgcgggactcggcttgctgaaagtgcactcggcaagaggcgagagcggcggctggtgagtacgccaaattttatttgactagcggaggctagaaggagagagatgggtgcgagagcgtcaatattaagaggcggaaaattagatgcctgggaaaaaattaagttaaagccaggggggaaagaaaacatatatgatgaaacacctagtatgggcaagcagggagctggaaagatttgcacttaaccctgaccttttagagacaccagaaggctgtaaacaaataatgagacagctgcaaccagctcttcagacaggaacagatgaacttaggtcattatataatacagtagcaaccctctattgtgtacatcaaaagatagatgtaaaagacaccaaggaggccttagacaagatagaggaagaacaaaacaaaagtcagcaaaaaacacagcaggcagaagcagctgacaaaggaaaagtcagtcaaaattaccctatagtgcaaaatgcacaagggcaaatggtacaccaggccatatcacctagaactttgaatgcgtgggtaaaagtaatagaggagaaggcttttagccaagaggtaatacccatgtttacagcattatcagaaggagccaccccacaagatttaaacaccatgctaaatacagtggggggacatcaagcagccatgcaaatgctaaaagatacaatcaatgaggaggctgcagagtgggatagggtacatccagtgcaggcagggcctgttgcgccaggccagataagagaaccaaggggaagtgacatagcaggaactactagtacccttcaggaacaaatagcatggatgacaaataacccacctattccagtgggagaaatttataaaagatggataattctggggttaaataaaatagtaagaatgtatagccctgtcagcatattggacataaaacaagggccaaaggaaccttttagagactatgtagaccggttctttaaaaccttaagagccgaacaagcttcacaagatgtaaaaaattggatgacagataccttgttagtccaaaatgcgaacccagattgtaagaccattttaagagcattagggccaggggcttcattagaagaaatgatgacagcatgccagggagtgggaggacccggccataaagcaagggttttggctgaagcaatgagccaagtacaacaaccaaacataatgatgcagagaggcaattttaagggccagagaagaattattaagtgtttcaactgtggcaaagaaggacacctagccagaaattgcagggcccctagaaaaaagggctgttggaaatgtggaaaggagggacaccaaatgaaagactgcactgagagacaggctaattttttagggaaaatttggccttccaacaaggggaggccaggaaattttccccagagcagactggagccaacagccccaccagcagagaactttggaatgggggaagagatagcctctcctctgaaacaggagcagaaagacagggaacctttaatttccctcaaatcactctttggcaacgaccccttgtcacagtaaaaataggaggtcagctaagagaagctctattagatacaggagcagatgatacagtattagaagaaataaatttgccaggaaaatggaaaccaaaaatgatagggggaattggaggttttatcaaggtaaaacagtatgatcaaatacttatagaaatttgtggaaaaaaggctataggtacagtattagtaggacctacatctgtcaacataattggaagaaatatgttgacccagattggttgtactttaaactttccaattagtcctattgagactgtaccagtagcattaaagccaggaatggatggcccaaaggttaaacaatggccattgacagaagaaaaaataaaagcattaagagaaatttgtacagaaatggaaaaagagggaaaaatttcaaaaatcgggcctgaaaatccatataacactccagtatttgccataaaaaagaaggacagtactaagtggagaaaattagtagatttcagggaactcaacaaaagaactcaagacttttgggaagtccaattagggataccacacccagcagggttaaagaagaaaaaatcagtgacagtactggatgtgggggatgcatacttctcagttcctttagatgagagcttcaggaaatatactgcattcaccatacctagtataaacaatgaaacaccaggaattaggtatcaatataatgtgcttccacagggatggaaaggatcaccagcaatattccaaaatagtatgacaaaaatcttagagccctttagggcacaaaaccaagaaatagtgatctatcaatatatggatgacttgtacgtaggatctgacttagaaatagggcaacatagagcaaaaatagaggagttaagagaacatctattaaagtggggatttaccacaccagacaagaaacatcagaaagaacctccatttctttggatggggtatgaacttcatcctgacaaatggacagtacaacctatacagctgccagaaaaggatagctggactgtcaatgatatacagaagttagtgggaaaattaaactgggcaagtcagatttacccaggggttaaagtaaggcaattgtgtaaactccttaggggaaccaaagcattaacagacatagtaccactaactgaagaagcagaattagaattggcagaaaacagggaaattttaaaagaaccagtacatggagtatattatgacccatcaaaagacttaatagctgaaatacagaaacaggggcatgaccaatggacatatcaaatttaccaagaaccattcaaaaatctgaaaacaggaaagtatgcaaaaaggaggactgcccacactaatgacgtaaaacagttaacagaggcagtgcaaaagatagccatggaaagcatagtaatatggggaaagactcctaaatttagattacccatccagaaagaaacatgggaaacatggtggacagactattggcaagccacctggattcctgagtgggagtttgttaatacccctcccctagtaaaattatggtaccagctagagaaagaacccatattaggagcagagactttctatgtagatggagcagctaatcgggaaactaaaataggaaaagcagggtatgttactgacagaggaaggcagaaaattgtttctctaactgaaacaacaaatcagaagactgaattacaagcaattcagctagctttacaggattcaggatcagaagtaaacatagtaacagactcacagtatgcattaggaatcattcaagcacaaccagatagcagcgaatcggaggcagtcaatcaaataatagaacagttaataaaaaaggaaagagtctacctgtcatgggtaccagcacataaaggaattggaggaaatgaacaagtagataaattagtaagtagtggaatcaggagagtgctgtttctagatggaatagataaggctcaagaagaacatgaaagatatcacagcaattggagagcaatggctagtgattttaatctgccacctatagtagcaaaggaaatagtagccagctgtgataagtgtcagctaaaaggggaagccatgcatgggcaagtagactgtagtccagggatatggcaattagactgtacacatctggaaggaaaaataatcctggtagcagtccatgcagccagtggttatatagaagcagaggttattccagcagaaacaggacaagaaacagcatactttatactaaaattagcaggaagatggccagtcaaagtaatacatacagacaatggcagtaatttcaccagtaatacagttaaagcagcctgttggtgggcaggtatccaacaggaatttggaattccctacaatccccaaagtcagggagtaatagaatccatgaataaagaattaaagaaaatcatagggcaggtaagagatcaagctgagcaccttaggacagcagtacaaatggcagtattcattcacaattttaaaagaaaaggggggattggggggtacagtgcaggggaaagaataatagacataatagcaacagacatacaaactaaggaattacaaaaacaaattacaaaaattcaaaattttcgggtttattacagggacagcagagatccaatttggaaaggaccagccaaactactctggaaaggtgaaggggcagtagtaatacaggacaatagtgatataaaagtagtaccaagaagaaaagcaaagatcattagggattatggaaaacagatggcaggtgatgattgtgtggcaggtagacaggatgaagattagaacatggaatagtctagtaaagcaccatatgtatgcttcaaggagagctaagggatggttttatagacatcattatgaaagcagacatccaaaaataagttcagaagtacacatcccattaggggaagctagattagtaataaaaacatattggggtttgcaaacaggggaaagagattggcatttgggtcatggagtctccatagaatggagattgagaagatataagacacaagtagaccctggcctggcaggccaactaatccatatgcattattttgattgttttgcagactctgccataaggaaagccatattaggacatatagttagccctaggtgtgactatcaagcaggacataataaggtaggatctctacaatacttggcactgacagcattgataaaaccaaaaaagataaagccacctctgcctagtgttagtaaattagtagaggataaatggaacaagccccagaagaccaggggccgcagagggaaccatacaatgaatggacactagagcttttagaggcactcaagcaggaagctgtcagacactttcctagaccatggctccatgacttaggacaatatatctatgaaacctatggggatacttggaggggagtagaagctataataagaattctgcaacaactactgtttatccatttcagaattgggtgccggcatagcagaataggcattttgcaacagagaagagcaagaaatggagccagtagatcctaaactagagccctggaaccatccaggaagtcagcctaaaactgcctgtaataactgttattgtaaacactgtagctatcattgtctagtttgcttccaggcaaaaggcttaggcatttcctatggcaggaagaagcggagacagcgacgaaacgctcctccaagcagtgaagatcatcaaaatcctatatcaaagcagtaagtagtaataaacagtatatgtaatgacttctttagaaatctatgcaatagtagcactgatagtggcgctaatcatagtgatagttgtgtggactttagcaggtatagaatataagaaattgctaaagcaaaggaaaatagataggttaattaagaaaataagagaaagagcagaagatagtggcaatgagagtgatggggacattgatgaattatcaaaacttgtgggggtggggaactatgatcttggggatgttaacaatttgtagtgctgcaaacaacttgtgggttactgtctactatggggtacctgtgtggaaagacgcagagaccaccttattttgtgcatcagatgctaaagcatatgatccagaaaagcataatgtctgggctacacatgcctgtgtacccatagaccccgacccacaagaaatacatttggaaaatgtgacagaagagtttaacatgtggaaaaataacatggtagagcagatgcatacagatataatcagtctatgggaccaaagcctaaagccatgtgtaaagttaacccctctctgcgttactttagagtgtaacaacatcaccaatgtcaacaacactgtcaacattacggatgacatgaaaggagaaataaaaaactgctctttcaatatgaccacagaattaagggataagaaacagagagtgtattcacttttttataggcttgatatagtacaaattaatagcaatagtaataacagtagtcataatcagtataggttaataaattgtaatacctcagccattacacaggcttgtccaaaggtatcctttgagccaattcccataaattattgtgccccagctggtttcgcgattctaaagtgtaaagataaaaagttcaatggaacagggccatgcaagaatgtcagcacagtacaatgcacacatggaatcaagccagtagtatcaactcagctgctgttaaatggcagtctagcagaagaagagataataattagatctgaaaatattacaaacaatgccaaaaccataatagtacaacttaacgagactgtacaaattaattgttccagacctaacaacaatacaagaaaaagtgtacatataggaccaggacaagcattttatgcaacaggtgacgtaataggggatataagacaagcatattgtactgtcaatggaacaaaatggaatagaactttacaaaaggtagcagaaaaattaagtcactactttgagaacattacaacaataatttttaagaactcctcagggggggatttagaaattacaacacatagttttaattgtggaggagaatttttctattgtaatacatcaggcttgtttaatagcacctggagtaaaagaaatggcacctggcagtcaaatggcacagaattaaatataacactcccatgcagaataaagcaaattataaatatgtggcagaggacaggacaagcaatgtatgcccctcccatccaaggagtaataagctgtgtatcaaacattacaggactactattaacaagagatggtggaaataataatactacaactgaaaccttcagacctggaggaggagatatgagggataattggagaagtgaactatataaatataaagtagtaaaaattgaaccactaggagtagcacccaccagggcaaagaggagagtggtggagagagaaaaaagagcagttggactgggagctgtcttcattgggttcttaggagcagcaggaagcactatgggcgcggcgtcaataacgctgacggtacaggccagacaattattgtctggcatagtgcaacagcaaagcaatttgctgagggctatagaggctcaacagcatctattaaaactcacagtctggggcattaaacagctccaggcaagagtcctggctctggaaagatacctaagggatcaacagctcctaggaatttggggctgctctggaaaactcatctgcaccactaatgtgccctggaactctagttggagtaataagactcagcaggaaatatgggataacatgacctggcagcaatgggataaagaaattggcaattacacacaaataatatatagtctaattgaagaatcgcagaaccagcaggaaaagaatgaacaagacttattggcattggacaagtgggcaaatctgtggaattggtttgacatatcaaattggctgtggtatataaaaatattcataatgatagtaggaggcttaataggtttaagaataatttttgctgtgctctctatagtgaacagagttaggcagggatactcaccattatcgtttcagacccttatcccaaacccgaggggacccgacaggctcggaggaatcgaagaagaaggtggagagcaagacagaggcagatccattcgattagtgagcggattcttagcacttgcctgggacgacctacggagcctgtgccttttcagctaccaccgattgagagacttactattgattgcagcgaggacggtggaacttctgggacgcagcagtctcaggggactacagagggggtgggaaacccttaagtatctaggaaatcttgtgcagtattggggtctggaactaaaaaggagtgctattaatctgcttgataccacagcaatagtagtagctgaaggaacagataggattatagaattaatacaaagaattagcagagctatctataacatacctagcagaataagacagggctttgaagcagctttgcaataaaatgggaagcaagtggtcaaaatgtagtccagtaggatggcctgctgtaagagaaagactaaggcaaactgagccagcagcagagggagtaggagcagcgtctcaagacctagacaaatatggggcacttacaagtagcaacacacccagcaacaatgctgattgtgcctggctggcagcacaagaggaggaaaacgaagtaggctttccagtcagacctcaggtgcctttaagaccaatgacttataaagcagcagttgatctcagcttctttttaaaagaaaaggggggactggaagggttaatttactctaagaaaaggcaagacatcctggatttgtgggtctataacacacaaggctacttccctgattggcaaaactacacaccaggaccaggggtcagatatccactgacttttggatggtgttacaagctagtgccagttgacccaagggaagtggaagaagccaatgaaggagaggacaactgcttactacaccctctgagccagcatggaatggaggatgaggacagagaagtcttaaagtggaagtttgacagtcacctagcacacagacacatggcccgcgagctacatccggagtattataaagactgctgacacagaagggactttccgctgggactttccactggggcggtccaggaggtgtggtctgggcgggacggaggagtggccaaccctcagatgctgcatataagcagctgctttttgcctgtactgggtctctctgggtagaccagatctgagcctgggagctctctggctatctagggaacccactgcttaagcctcaataaagcttgccttgagtgctct

SEQ ID NO: 5 - DNA, 8966 bp, Human immunodeficiency virus type 1
  isolate="92NG003"; 157..1650:gene:"gag";4408..4986:gene:"vif"; 4926..5039:gene:"vpr"; 5184.7762:tat; 5323..7967:gene:"rev"; 5425..5654:gene:"vpu"; 5572..8109:gene:"env"; 8111..8731:gene:"nef"
ttgaaagcgaaagttaacagggactcgaaagcgaaagttccagagaagttctctcgacgcaggactcggcttgctgaggtgcacacagcaagaggcgagagcggcgactggtgagtacgccaatttttttgactagcggaggctagaaggagagagatgggtgcgagagcgtcagtattaagcgggggaaaattagatgcatgggaaaaaattcggttgaggccagggggaaagaaaaaatatagaatgaaacatttagtatgggcaagcagggaactggagagatttgcacttaaccctgacctcttagaaacaacagaaggttgtcagcaaataatgagacagctgcaaccatctctccagacaggaacagaggagattaaatcattatttaatacagtagcaaccctctattgtgtacatcaaaggatagaggtaaaagacaccaaagaagctctagaggaagtggaaaaaatacaaaagaacagtcagcaagaaacacagaaggcagcaatgggtaaaggaaacagcagccaagttagccaaaattatcctatagtgcagaatgcacaagggcaagtggtacaccagcccatatcacctaggactttaaatgcatgggtaaaagtaatagaagaaaagaacttcagtccagaagtaatacccatgtttacagcattatcagaaggagccaccccacaagatttgaataccatgctaaacaccgtgggggggcatcaagcagctatgcaaatgctaaaagattctattaatgaagaagctgcagagtgggataggctacatccacaacaggcaggacctattccaccaggccagataagagaaccaaggggaagtgatatagcaggaactactagtaccctgcaggaacaaataacatggatgaccagcaacccacctatcccagtgggagaaatttataaaagatggataattctggggttaaataaaatagtgagaatgtatagccctgtcagtattttagacataaaacaagggccaaaagaacccttcagagattatgtggataggttctttaaaactttgagagctgagcaagccacacaggaggtaaaaaactggatgacagacaccttgttggtccaaaatgcgaacccagattgtaagaccatcctaagagcattaggagcaggagctacactagaagaaatgttgacagcatgtcaaggagtgggaggacccagccacaaagcaagagttttagctgaggcaatgagccgggcaacaggtacatcagcagccataatgatgcagaaaaacaattttaagggcccgagaagaggtattaagtgtttcaactgtggcaaggaaggacatctagccagaaattgcagggcccctaggaaaaaaggctgttggaaatgtggaaaggagggacatcaaatgaaagactgcacagagagacaggctaattttttagggaaaatttggccttccaacaaggggaggccagggaattttcttcagaacaggccagagccaacagccccacccgcagagagcttcgggttcggagaggagatagccccttccctgaagcaggagccgagggaaaaggaatcacctccattaacctccctcaaatcactctttggcaacgacccctagtcacagtaagaatagggggacagctaatagaagctctattagacacaggagcagatgatacagtattagaacaaataaatttaccaggaaaatggaaaccaaaaatgatagggggaattggaggatttatcaaagtaaaacagtatgatcaaatacttatagaaattgaagggaaaaaggctatagggacagtactagtaggacctacacctatcaacataattgggagaaatatgttgactcaaattggttgtactttaaattttccaattagtcctattgagactgtaccagtaaaattaaaaccaggaatagatggcccaaaggttaaacaatggccattgacagaagagaaaataaaagcattaacagaaatttgtacagatatggaaaaggaaggaaaaatttcaaaaattgggccagaaaatccatacaacactccaatatttgccataaagaaaaaagacagtactaaatggagaaagttggtagatttcagagagctcaataaaagaactcaagacttctgggaggtccaattaggcatacctcatcccgcggggttaaaaaagaaaagatcagtaacagtactagatgtgggggatgcatatttttcaattcccctagatgaaaactttagaaagtatacagcattcactatacctagtataaataatgagacaccagggattagatatcagtacaatgtgcttccgcaaggatggaaaggatcaccagcaatatttcagagtagcatgacaaaaatcttagaaccctttagaacagaaaatccagaaatagtgatctatcagtacatggatgatttatatgtaggatctgacttagaaacagggcagcatagagcaaaaatagaggaattaagaaatcatctactgagatggggatttaccacaccagataaaaaacatcagaaagaacctccatttctctggatgggatatgagctccatcctgacaaatggacggtacaacctatacagctgccaaacaaagaaagctggactgtcaatgatatacaaaaattagtgggaaaactaaattgggcaagtcagatttatccagggattaaagtaaagcaactatgtaaactccttaggggggccaaagcactaacagacatagtaccactgactgaagaagcagaattagaattggcagagaacagggaaattctaaaagaacctgtacatggagtctactatgacccatcaaaagaattaatagcagaattacagaaacaagggtgcgaccaatggacatatcaaatttatcaagagccatacaaaaatctgaaaacaggaaagtatgcaaaaagggggtctgcccacactaatgatgtaaaacagttaacagaagcagtgcaaaaaatagccacagagagcatagtaatatggggaaaagttcctaaatttaaactacctataaggaaagaaacatgggaagtatggtggacagaatattggcaggccacctggattcctgattgggagtttgtcaatacccctcctctagtaaagttatggtatcgattagaaacagaacccataccaggagcagaaacttactatgtagatggggcagctaataaagaaacaaaattaggaaaggcaggatatgttactgacagaggaaaacaaaaaattatcaccatacaggaaacaacaaatcaaaaaactgaattacacgcaattcagctagctttgcaggattcaggatcagaagtaaacatagtaacagactcacagtatgcattaggaatcattcaagcacaaccagataggagtgaatcagaattagtcaatcaaataatagaacagctaataaaaaaggaaaaggtctacttaacatgggtaccagcacacaaaggaattgggggaaatgaacaagtagataaattagtcagtagtggaatcagaaaagtactgtttttagatggcatagacaaagctcaagaggaccatgaaagatatcacagcaattggagagcaatggctagtgattttaatctgccacctatagtagcaaaagaaatagtggccagctgtgataaatgtcagctaaaaggggaagccatgcatggacaagtagactgtagtccaggaatatggcaattagattgcacacatctagaaggaaaagtcattatagtagcagtccatgtagccagtggctatatagaagcagaagttatcccagcagaaacaggacaggagacagcatacttcctgctaaaattagcaggaagatggccagtaaaagtaatacacacagacaatggcagcaatttcaccagtgctgcaatgaaagcagcctgttggtgggcaaatatccaacaggaatttggaattccctacaatccccaaagccaaggagtagtggaatctatgaataaagaattaaagaaaattatagggcaggtcagggatcaagctgaacacctcaagacagcagtacagatggcagtattcattcacaattttaaaagaaaaggggggattggggggtacagtgcaggggaaagaataatagacataatagcatcagatatacaaactaaagaactacaaaaacagattataaaaattcaaaattttcgggtctattacagggacagcagagaccccatttggaaaggaccagcaaaactactctggaaaggtgaaggggcagtagtaatacaggacaatagtgagataaaggtagtaccaagaagaaaagtaaaaatcattaaggattatggaaaacagatggcaggtggtgattgtgtggcaggtagacaggatgaggattagaacatggaacagtttagtaaaatatcatatgtataaatctaagaaagctaaggattggttttatagacatcactatgaaagtaggcatccaaaagtaagttcagaagtacacatcccactaggggaggctagattagtagtaagaacatattggggtctgcatacaggagaaagagactggcacttgggtcagggggtctccatagaatggaagcagagaagatatagcacacaaatagatcctgacctagcagaccaactgattcacctgcattattttaactgtttttcagaatcggccgtaaggaaagccatactaggagaagtagttagacctaggtgtgaatatcaaacaggacataatcaggtaggatcactacaatatttagcactcaaagcattagtaacaccaacacagacaaagccacctttacctagtgttaagaagttaacagaagatagatggaacgagccccagaagaccaggggccacagagggagccattcaacgaatggacactagaactgttagaagaacttaaacatgaagctgttagacatggcttcatggattaggacaacatatttataacacctatggggatacttgggaaggagttgtagctataataagaatattgcaacaactactttttattcatttcagaattgggtgtcaacatagcagaataggcattattccagggagaagaggcaggaatggagctggtagatcctagcctagagccctggaaccacccaggaagtcagcctacaactgcttgtaacaaatgttactgtaaaatatgctgctggcattgccaattgtgctttctgaacaagggcttaggcatctcctatggcaggaagaagcggagacgccgacgaggaactcctcagagtcaccaggatcatcaaaatcctgtaccaaagcagtgagtagtaatagttagtatatgtgatgcaatccttagaaatagctgcaatagcaggactagtagtagcagccatagcagccatagttgtgtggaccatagaaaaataaagaaacaggagaaaatagacaggttacttgatagaataagagaaagagcagaagatagtggcaatgagagtgaaggggacacagaggaattggcaacacttgtggacatggtggactttgatccttgggttggtgataatttgtagtgcctcaaataacttgtgggtcacagtctattatggggtaccagtgtgggaagacgcagatacccctctattttgtgcatctgatgctaaagcatatagtactgaaagacataatgtctgggccacacatgcctgtgtacccacagaccccaacccacaagagataactctggaaaatgtaacagaaacttttaacatgtggaaaaataacatggtagaacagatgcatgaggatataatcagtttatgggatgaaagcctaaagccatgtgtaaagctaacccctctctgtgttaccttaaactgtactaatgtcaattgtaacagtaatgtgaccagcactgggaacagtgctgggaccaacgctacgtgtaacatagaagaagcaaacaacttaaaaaactgctctttcaatataaccacagaaataagagataagaaaaagacagaatatgcgcttttctatagacttgatgtggtaccaatcgatggtaataataatgtctcaaataactataggctaataaattgtaatgtctcaaccattaaacaagcttgtccaaaggtgtcttttgacccacttcccatacattattgtgctccagctgggtttgcgattttaaagtgtaggggtaagaatttcactggaacaggacaatgtaaaaatgtcagttcagtacaatgtacacatggaattaaaccagtggtatcaactcaattactactaaatggtagtctagcagaaggagaaatagtaattagatctgaaaacctcacagacaatgccaaagtcataatagtacagcttaataaaactataggaattaattgtaccagacccaacaacaatacaagaaaaagtataagaatcggacctggacaagcgttctatgcaacaggtgaaataataggacaagaatggcaggagatgttacagaaggtacaggcacaactagaacaggtctttaacaaaagtataacctttaactcatccgcaggaggggacctagaaattacaacacatagttttaattgtagaggagaatttttctattgtaatacatcaggattgtttaatgaatcaggagggaatgataccactatcacactcccatgtaagataaaacaaattgtgagaatgtggcagagagtgggacaagcaatgtatgcccctcccatcgcaggagatattacatgtagatcaaacattacagggctattattaacaagagatggtggggttaataatactggaaatgagaccttcagacctggaggaggagatatgagggacaattggagaagtgaattatataagtataaaatagtaaaaattaaaccactaggaatagcacccaccaaggcaaggagaagagtggtggagagaggaaaaagggcagttggactgggagctgtcttccttgggttcttaggagcagcaggaagcactatgggcgcggggtcaataacgctgacggtacaggtcagacaattattgtctggcatagtgcaacagcaaagcaatttgctgagggctatagaggcgcagcaacatctattgcaactcacagtctggggcattaaacagctccaggcaagagtcctggctgtagaaagatacctaaaggatcaacagctcctagggatttggggctgctctggaaaactcatctgcaccactaatgtgccttggaacactagttggagtaataaatcttatgaggagatttgggataacatgacctggatacaatgggaaagggaagtcagcaattacacacaacaaatatacagcctaattgaagaatcgcagaaccagcaggaaaagaatgaacaagacttattggcattggacaagtgggcaagtttgtggaactggtttgacataacaaaatggctatggtatataaaaatatttataatgatagtaggaggtttaataggtttaagaatagtttttgctgtgctttctatagtaaatagagttaggcagggatactcacctttgtcattccagacccttacccaccaccagagggaacccgacaggcccgaaagaatcgaagaaggaggtggagagcaagacagagacagatcagtgcgcttagtgagcggattcttagcacttgcctgggacgacctgcggaacctgtgcctcttcagctaccaccgattgagagacttagtcttgattgcagcgaggacagcagaactcctgagacgcagcagtctccagggactgagactggggtgggagggcctcaaatatctgtggaatctcctgttgtattggggtcgggaactaaagaatagtgctattaatttgattgatacaatagcaatagcagtagctaactggacagatagggttatagaagtagcacaaggagcttgtagagctattctcaacatacctagaaggataagacaaggcttggaaagagctttgctataaaataggaggcaagtggtcaaaaagtagcatagttggatggcccgcggtaagggagagaataagacaaacccctccagcagaaggagtaggagcagcacctcaagacttagctaggcatggagcaatcacaagcagcaatacagcacaaactaatcctgattgtgcctggctagaagcacaacaggagaattcagaggtaggctttccagtcagacaacaggtacctttgagaccaatgacttataaggctgcctttgatctcagcttctttttaaaagaaaaggggggactggatgggctaatttactctaagaaaagacaagacatccttgacctatgggtctataatacacaaggatacttcccagattggcagaactacactccagggccagggactagattcccactgacatttcggtggtgcttcaaactagtaccaatggatccagcagagatagaggaagccaataaaggagagaacaacagtttattacaccctatctgccaacatggcctggaagatgcggacagagaagtgctggtatggagatttgacagtagcctagcacggagacacatagcccgagaacaacatccggagtactataaggactgctgacacagaagttgctgacacagatgttgctgacaaggggactttccgcctgggactttccggggaggcgcggcatgggagggactggggagtggctaaccctcagaagctgcatataagcagccgcttctcgcctgtactgggtctctcttgttagaccagatttgagcctgggagctctctggctagcaggggaacccactgcttaagcctcaataaagcttgccttgagtgcttc

SEQ ID NO: 6 - DNA, 8954 bp, Human immunodeficiency virus type 1
  isolate=93BR029; 142..1579:gene="gag"; 1437..4448:gene="pol"; 4393..4971:gene="vif"; 4911..5201:gene="vpr"; 5182..7782:gene="tat"; 5321..7972:gene="rev"; 5586..8114:gene="env"; 8116..8736:gene="nef"
ctgaaagcgaaagtagaaccagaggagctctcttgacgcaggactcggcttgctgaagcgcgcacggcaggaggcgaggggcggcgactggtgagtacgccaaaaataaaatttggactagcggaggctagaaggagagagatgggtgcgagagcgtcagtaataagcgggggagaattagataaatgggaaaaaattaggttaaggccaggaggacataaaaaatatagattaaaacatatagtatgggcaagcaggggagctagaacgattcgcagttaatcctggccttttagagacatcagaaggctgtagacaaatactggaacagctacaaccagcccttaagacgggatcagaagaacttagatcattatataatacagtagcaaccctctattgtgtacatcaaaagatagatgtaaaagacaccaaggaagctttagaaaagatagaggaagagcaaaacaaagtaagaaaaaggcacagcaagcagcagctaacacaggaaacaacagccaggtcagccaaaattaccctatagtgcagaaccttcaggggcaaatggtacaccaggccatatcacctagaactttaaatgcatgggtaaaagtagtagaagagaaggcttttagcccagaagtaatacccatgttttcagcattatcagaaggagccaccccacaagatttaaacaccatgctaaacacagtggggggacatcaagcagctatgcaaatgttaaaagaaaccatcaatgaggaagctgcagaatgggacagagtacatccagtgcatgcaggacctatcccaccaggccagatgagggaacctaggggaagtgatatagctggaactactagtacccttcaggaacaaatacaatggatgacaagcaacccacctgtcccagtgggagaaatttataaaagatggatcatcctaggattaaataaaatagtaagaatgtatagccctaccagcattctgggcataagacaaggaccaaaggaaccctttagagactatgtagatcgattttataaaactctaagagcagagcaaacttcacaggatgtaaaaaattggatgacagaaaccttgttggtccaaaatgcgaacccagattgcaaaaccattttaaaagcattgggaccagcagctacactagaagaaatgatgacagcatgtcagggagtggggggacccggccataaagcaagagttttggcagaagcaatgagccaagtaacaaattcaggtaccataatgatgcagagaggcaattttaggaaccaaagaaagactattaagtgtttcaattgtggcaaagaagggcacatagccaaaaattgcagggcccctaggaaaaagggctgctggaaatgtggaaaggaaggacaccagatgaaagattgtactgagagacaggctaattttttagggaaaatctggccttcccacaagggaaggccagggaatttccttcagagcagaccagagccaacagccccaccagcagagagcttcaggtttggggaagaggtaacaactccctctcagaaacaggagccgatagacaaggagatgtatcctttggcttccctcagatcactctttggcaacgacccctcgtcacagtaaagataggggggcaactaaaggaagccctattagataccggagcagatgatacagtattagaagaaataaatttaccaggaagatggaaaccaaaaatgatagggggaattggaggttttatcaaagtaagacagtatgatcaaatacccatagaaatttgtggacgtaaagctacaggtacagtattagtaggacctacacctgtcaacataattggaagaaatctgttgactcagattggctgcactttaaattttcccattagtcctattgaaactgtaccagtaaaattgaagccaggaatggatggcccaagggttaaacaatggccattgacagaagaaaaaataaaagcattaacagaaatatgtacagaaatggaaaaagaaggaaaaatttcaaaaattgggcccgaaaatccatacaatactccagtatttgccataaagaaaaaagatagtactaaatggagaaaattagtagatttcagagaacttaataagagaactcaagacttctgggaagttcagttagggataccacatcccgcagggttaaagaagaaaaaatcagtaacagtactggatgtgggtgatgcatatttttcagttccattagataaagacttcaggaagtatactgcatttaccatacctagtacaaacaatgaaacaccagggcttagatatcagtacaatgtgcttccacaggggtggaaaggatcaccagcaatattccaaagtagcatgacaaaaatcttagagccttttagaaaacaaaatccagacatagttatctatcaatacatggatgatttgtatgtaggatctgacttagaaatagggcagcatagaactaagatagaggaattgagacagcatttgttgaggtggggatttaccacaccagacaaaaaacatcagaaagaacctccattcctttggatgggttatgaactccatcctgataaatggacagtacagcctatagtgctgccagaaaaagacagctggactgtcaatgacatacagaagttagtgggaaaattgaattgggcaagtcagatttatgcagggattaaagtaaggcaattatgtaaactccttaggggaaccaaagcactaacagaagtagtaccactaacagcagaggcagagctagaactggcagaaaacagggagattctaaaagaaccagtacatggagtgtattatgacccctcaaaagacttaatagcagaaatacagaaacaggggcaaggccaatggacatatcaaatttatcaagagccatataaaaatttgaaaacaggaaagtatgcaaggatgaggggtgcccacactaatgatgtaaaacaactaacagaggcagtgcaaaaaataaccacagaaagcatagtaatatggggaaagattcctaaatttaaactacccatacaaaaagaaacgtgggaagcatggtggatagagtattggcaagccacctggattcctgagtgggagtttgtcaatacccctcccttagtgaaattatggtaccagttagagaaagaacccatagtaggagcagaaactttctatgtagatggggcagctaatagggaaactaaattaggaaaagcaggatatgtgactgacagaggaagacaaaaagttgtccccctaacggacacaacaaatcagaaaactgagttacaagcaattcatctagctttgcaggattcgggattagaagtaaacatagtaacagactcacaatatgcattaggaatcattcaagcacaaccagataagagtgaattagaaatagtcaatcaaataatagagcagttaataaaaaaggaaaagatctacctggcatgggtaccagcacacaaaggaattggaggaaatgaacaagtagacaaattagtcagttctggaatcaggaaagtactatttttagatggaatagataaggcccaagaagaacatgagaaatatcacaataattggagagcaatggctagtgactttaacataccacctgtagtagcaaaagaaatagtagccagctgtgataaatgtcagctaaaaggagaagccatgcatggacaagtagactgtagtccaggaatatggcagctagattgtacacacttagaaggaaaagttatcctggtagcagtgcatgtagccggtggatatatagaagcagaagttattccagcagagacagggcaagaaacagcatactttctcttaaaattagcaggaagatggccagtaaaaacaatacacacagacaatggcagcaatttcaccagtactacagtcaaggccgcctgttggtgggcggggatcaagcaggaatttggcattccctacaatccccaaagtcaaggagtaatagaatctatgaataaagaattaaagaaaattataggacaggtaagggatcaggctgaacatcttaagacagcagtacaaacggcagtattcatccacaattttaaaagaaaaggggggattggggggtacagtgcaggggaaagaatagtagacataatagcaacagacatacagactaaagaattacaaaaacaaattacaaaaattcaaaattttcgggtttattacagagacagcagagatccactttggaaaggaccagcaaagcttctctggaaaggtgaaggggcagtagtaatacaagataatagtgacataaaagtagtgccaagaagaaaagtaaagatcattagggattatggaaaacagatggcaggtggtgattgtgtggcaggtagacaggatgaggattaacacatggaaaagtttagtaaaataccatatgcatgtttcaaagaaagccaaaagatggttttatagacatcactttgaaagcaggcatccaagagtaagttcagaagtacatatcccactagaggaagctaaattagtaataacaacatattgggggctgcatacaggagaaagagattggcatctgggtcagggagtctccatagaatggaggcaggggaggtataggacacaaatagaccctggcctggcagaccaactgatccatatatattattttgattgtttttcagaatctgccataaggaaagccatattaggacatagaattagccctaggtgtgattatcaagcaggacataacaaggtaggatctctacagtacttggcactaacagcattaataaaaccaaaaaagagaaagccacctttgcccagtgttaagaaactgacagaggatagatggaacaagccccagaagaccaaggaccacagagggagccatacaatgaatggacactagaacttttagaggaacttaagagtgaagctgttagacattttcctaggttatggctccatagcttaggacaacatatctatgaaacttatggggatacttgggcaggagtggaagccataataagaattctgcaacaactgctgtttattcatttcagaattggatgtcaacatagcagaataggcattaatcgacagaggagagcaaggaatggagccagtagatcctagactagagccctggaagcatccaggaagtcggcctcagacggcttgtaatagttgctattgtaaaaagtgttgctttcattgtcaagtttgtttcacaacaaagggcttaggcatctcctatggcaggaagaagcggagacagcgacacagaactcctcaaagcagtcagctacatcaagatcctgtaccaaagcagtaagtattgttaagtaatatatgtaatgtcatatttgttagtaataggtttagcagcattaatagcagcactaataatagcaatagttgtgtggactatagcatatatagaatatagggaactagtaaggcaaagaaaaataaataggttatataaaagaataagagaaagagcagaagacagtggcaatgagagtgagggggatgcagaggaattggcagcacttggggaaatggggccttttattcctggggatattgataatctgtaatgctgaaaacttgtgggtcacagtctattatggggtacctgtgtggaaagaagcaaccactactttattctgtgcatcagatgctaaagcatatgaaaaagaagcacataatgtctgggctacacatgcctgtgtacccacagatcccaatccacaagaagtagttctggaaaatgtaacagaaaattttgatatgtggaaaaataacatggtagaacaaatgcatacagatataatcagtttatgggatcaaagcctgaagccatgtgtgaagttaaccccactctgtgttactttacgttgtagtaatgccactaccaacagtactcaaaacgacaccctgaaggaagagccaggggcaatacaaaactgttctttcaatatgaccacagaagtaagagataagcagctgaaagtacatgcacttttttataggcttgatatagtaccaatcagcaatgataatagtagcaatgataatagtagcagagaatacaggctaataaattgtaatacctcaacccttacacaggcttgtccaaaggtatcttgggatccaattcccatacattattgtgctccagctgggtatgcgattctaaagtgtaatgataaaaaattcaatgggacggggccatgcaggaatgtcagcacagtacaatgtacacatggaattaaaccagtggtatcaactcaattgttgttaaatggcagcctagcagaaaaagatataataatcagatctcaaaatatctcagataatgcaaaaaccataatagtacaacttaatgtatctgtgccgattaattgtacaagacccaacaacaatacaagaaaaagtataccaataggaccaggacgagcattttatacaacaggagaaataataggagacatcagaaaggcacattgtaacgttagtggaacaaaatggaatgagacgttagaaaaggtaagggcaaagttaaagcctcatttccctaatgcaacaataaaatttaactcatcctcaggaggggacctagaaattacaatgcatagttttaattgtagaggagaatttttctactgcaatacatcaggactgtttaatgacacagtagacaatggcactatcactctcccatgtcgaataaagcaaattgtaaatatgtggcaggaagtggggcgagcaatgtatgccgctcccattgcaggaaacattacctgtagctcaaatattacaggtctactattgacaagagatggtggtcagaataatcagacggaggagaccttcagacctgggggaggaaatatgaaagacaactggagaagtgaattatataaatataaagtagtagaaattgagccattaggagtagcacccaccaaggcaaaaagacaagtggtgaagagagaaaaaagagcagtgggaatgggagctttgttccttgggttcttgggagcagcaggaagcactatgggcgcagcgtcaataacgctgacggcacaggccagacaattattgtctggcatagtgcaacagcagaataatttgctgagggctattgaagcgcaacagcatctgttgcagctcacagtctggggcattaaacagctccaggcaagaatcctggctgtggaaagatacctaaaggatcaacagctcctagggctttggggctgctctggaaaactcatctgcaccactgatgtgccctggaactctagttggagtaacaaatctcaggagaagatctgggggaacatgacctggatggagtgggaaaaagagattagcaattactcaaacgaaatatataggttaattgaagagtcgcagaaccagcaggaaaagaatgaacaagaattattggcattggacaaatgggcaagtctgtggaattggtttgacatatcaaaatggctgtggtatataaaaatattcataatgatagtaggaggcttgataggcttaagaatagtttttgctgtgctttctatagtaaatagagttaggaagggatactcacctttgtcattacagacccgcttcccaagcccaagggaacccgacaggcccgaaggaatcgaagaaggaggtggagagccaggcaaagacagatccgtgagattagtgaacggattcttagctcttgtctgggacgacctgaggaacctgtgcctcttcagctaccgccacttgagagacttcatattaattgcagcgaggattgtggacaggggactgaagagggggtgggaagccctcaaacttctggggaatctcgcgctgtattggagtcaggaactaaagaatagtgctattagcttgcttaataccacagcaatagtagtagctgaggggacagatagagttatagaagctttgcaaagagcgggtagagctgttcttaacgtacctagaagaataagacagggcttggaaagggctttgctataaaatgggtagcaagtggtcaaaaagtagtatagttgggtggcctgctataagggaaagattaagacaaacccctccagcagcagaaggggtgggagcagtgtctcaagacttagaaagacggggggcaattacaagcagcaatactggagctaataatcctgacttggcctggctggaggcacaagaggaagaggaagtaggctttccagtcagacctcaggtacctttaagaccaatgacttataagggagctcttgatctcagtcactttttaaaagaaaaggggggactggaagggttaatttattccaagaaaagacaagagatccttgatctgtgggtttaccacacacaaggctacttccctgattggcagaactacacaccagggccagggaccagatatccactgaccttagggtggtgcttcaagctagtaccagttgacccagaggaggtagaaaaggccaatgaaggagagaacaactgcttgctacaccccatgagccaacatggaatggaggatgaagacagagaaatactgcagtggaggtttgacagccgcctagcatttcatcacatggcccgagagctgcatccggagtactacaaggactgctgacattgagttttctacaagggactttccgctggggactttccagggaggtgtggcctgggcgggactggggagtggcgagccctcagatgctgcatataagcagctgctttctgcctgtactgggtctctctggttagaccagatttgagcctgggagctctctggctagctagggaacctactgcttaagcctcaataaagcttgccttgagtgctta

SEQ ID NO: 7 - DNA, 9050 bp, Human immunodeficiency virus type 1
  isolate="94CY032.3"; 156..1658:"gag"; 1454..4462:"pol"; 4407..4985:"vif"; 4925..5212:"vpr"; 5200..7842:"tat"; 5339..8026:"rev"; 5435..5680:"vpu"; 5598..8168:"env"; 8170.8829:"nef"
ttgaaagtgaaagttaataggactcgaaagcgaaagttccagagaagttctctcgacgcaggactcggcttgctgaggtgcacacagcaagaggcgagagcggcgactggtgagtacgccaaattttttgactagcggaggctagaaggagagagatgggtgcgagagcgtcagtattaagtgggggaaaattagatgcatgggagaggattcggttaaggccagggggaaagaaaaaatatagactgaaacatctagtatgggcaagcagagagttggaaagattcgcacttaaccctggccttttagaaacagcagaaggatgtcaacaattaatggaacagttacaatcaactctcaaaacaggatcagaagaacttagatcattatataatactataacaaccctctggtgcgtacatcaaagaatagatgtacaagacaccaaggaagctttagataaaatagaggaaatacaaagtaagagcaagcaaaagacacagcaggcagcagctgccgcaggaggtagcagcaatgtcagccaaaattaccctatagtgcaaaatgcacaagggcaaatggtacatcagagcatttcacctagaactttgaatgcatgggtaaaagtaatagaagaaaaggctttcagcccagaagtaatacccatgttctcagcattatcagagggagccaccccacaagatttgaacatgatgctaaatatagtggggggacaccaggcagcaatgcaaatgttaaaagataccatcaatgaggaagctgcagactgggacaggacacatccagtacatgcagggcctattccaccaggccagatgagagaaccaaggggaagtgatatagcaggaactactagtacccttcaagaacaaataggatggatgacaagcaacccacctgtcccagtgggagaaatctataaaagatggataatcttggggttaaataaaatagtaagaacgtatagccccattagcatcttggacataagacaaggaccaaaagaacccttcagagattatgtagataggttctttaaatgtctcagagcagaacaagctacccaggaggtgaaaaattggatgacagaaaccctgctggtccaaaatgcgaatccagactgtaagtccatcttaaaagcattaggaacaggggctacattagaagaaatgatgacagcatgtcagggagtgggaggacccagccataaagcaagagttttagctgaggcaatgagccaggcatcaaatgcagcagcagccataatgatgcagaaaagcaaatttaagggccaaagaagaactattaagtgtttcaactgtggcaaggaaggacatctagccagaaattgcagggcccctaggaaaaagggctgctggaagtgtggaaaggagggacatcaaatgaaagactgcactgagagacaggctaattttttagggagaatgtggccttccagcaaagggaggccaggaaattttcttcagaacaggccagagccaacagccccgcccgcggaatgcttagagaggaaagaggagacaacctcctctctgaagcaggaaccgagggacaaggaactatatcctttaacttccctcaaatcactctttggcagcgaccccttgtcacaataaaactagggggacagataagggaggctcttttagatacaggagcagatgatacagtattagaagaaataaatttgccaggaaaatggaagccaaaaatgatagggggaatcggaggttttatcaaagtaagacaatatgatcagatacctatagaaatttgtggaaaaaaggccataggcacagtgttagtaggacctacacctgtcaacataattggacgaaacatgttgactcagcttggttgtactttaaattttccaattagtcctattgaaactgtaccagtaaaattaaagccaggaatggatggcccaaaggttaaacaatggccattgacagaagaaaaaataaaagccttaacagagatatgtacagacatggaaaaggaaggcaagatttcaaaaattgggcctgaaaatccatacaatactccaatatttgctataaagaaaaaagacagcactaaatggagaaaattagtagatttcagagaactcaataaaagaactcaggacttctgggaagttcagttaggaataccgcacccagcagggttaaagaagaaaaaatcagtaacagtattggatgtgggggatgcatatttttcagttcccttagatccagagttcaggaagtacactgcattcaccatacctagtaccaacaatgagacaccaggaattagatatcagtacaatgtgcttccacagggctggaaaggatcaccagcaatattccaatgtagcatgacaaaaatcttagagccctttagattcaaaaacccagaaatagtcatataccaatatatggatgatttgtatgtagggtctgacttagaaatagggcaacatagagcaaaaatagaagagctaagagagcatctattgagatggggattcaccacaccagacaaaaaacatcagaaagaacccccatttctttggatggggtatgaactccatcctgacaaatggacagtgcagcctatacaaccggcagaaaaggatagctggactgtcaacgatatccagaagttagtgggaaaactaaattgggcaagtcagatttatccagggattaaagtaaagcaattatgtaaacttcttaggggagctaaagccctaacagacatagtaccactaactacagaggcagagttagaattagcagagaacagggagattctaaaagaaccagtacatggggcatattatgacccatcaaaagacttaatagcagaaatacagaagcaagggcaaggtcaatggacatatcaaatatatcaagagccacataaaaatctgaaaacagggaagtatgcaagaaccagatctgcccacactaatgatgttagacaattaacagaagcagtgcaaaagatagccatggaatgcatagtaatatggggaaagactcctaagtttagattacccatacaaaaggaaacatgggacacatggtggacagaatattggcaggccacctggatccctgaatgggaatttgtcaatacccctcctctagtaaaattatggtaccagttagaaacagaccccatagcaggagcagaaactttctatgtagatggggcagctaatagagaaacaaaacagggaaaagcaggatatgttactgatagaggcagacaaaaagttgtctccctatctgaaacaacaaatcagaagactgaattacaagcaatttacttagctttgcaggattcaggatcagaagtaaacatagtaacagactcacagtatgcaataggaatcattcaagcacaaccagatagaagtgaatcagatttagttaatcaaataatagagcagttaatacggaaggacaaggtctacctgtcatgggtaccagcacacaaagggattggaggaaatgaacaagtagataaattagtcagcaatggaatcagaaaggtgctatttttagatggaatagataaggctcaagaagaacatgagaaatatcacaataactggagagcaatggctagtgattttaatctgccatcagtggtagcaaaagagatagtagctagctgtaataaatgtcagctaaaaggggaagccatgcatggacaagtggactgtagtccagggatatggcagttagattgtacacatttagaaggtaaagttatcatggtagcagttcatgtggctagtggatacatagaagcagaagttatcccagcagaaacaggacaggaaacagcctacttcatactaaaattagcaggaagatggccagtgaaaatgatacatgcagacaacggccccaatttcaccagtgctgcggttaaggcagcctgttggtgggcagatatcaaccaggaatttggaattccctacaatccccaaagccaaggagtagtggaatctatgaataaagaattaaagaaaatcatagggcaggtcagggatcaagctgaacaccttaagacagcagtacagatggcagtattcattcacaattttaaaagaaaaggggggattggggggtacagtgcaggggaaagaataatagacataatagcatcagatatacaaactaaagaactacaaaaacaaattacaaaaattcaaaattttcgggtttattacagggacagcagagaaccaatttggaagggaccagcaaaactactctggaaaggtgaaggggcagtagtaatacaggacaacagtgatatcaaagtagtaccaagaagaaaagcaaagattattagggactatggcaaacagatggcaggtaatgattgtgtggcaggtagacaggatgaagattagaacatggaacagtctagtgaaacatcatatgtatgtttcaaagaaagctaaaggatgattctatagacatcactatgaaagtaggcacccaaaagtaagttcagaagtacatatcccactaggggaggctagattagtagtaagaacatattggggtctgcagccaggggaacaagactggcacttgggtcatggagtctccatagaatggaggctcagaagatatagcacacaagtggatcctgacctggcagaccaactaattcatatgcattactttgattgtttttcagaatctgccataaggaaagccatattaggacatagagttagtcctaggtgtgaatatcaagcaggacataataaggtaggatccttacaatacctggcactagcagcattaatatccccaaaaaagacaaagccacctttgcctagtgttaagaaactagtggaggatagatggaacaagccccagaagaccaggggccgcagagagaaccaaataatgaatggacactagagcttttggaggagcttaaaaatgaagctgttaggcattttcctagaccctggctccatggcctaggacagcatatctataacacttatggagatacctgggaaggggttgaagctataataagaattttgcaacaactactgtttattcatttcagaattgggtgccaacatagtagaataggcattactcctcaaaggagaagaggcaggggatggagccagtagatcctgacctagagccctggaaccatccgggaagtcagcctacaactgattgtaacaagtgtttctgtaaaaagtgttgctggcattgccaagtttgctttctgaaaaaaggcttaggcatctcctatggcaggaagaagcggaaacatcgacgaggatctcttcaaggcagcaagggccatcaaaatcttataccaaagcagtaagtattaagtatatgtaatgttattctgggaaatctgggcaatagtaggactggtagtagcgctaattatagtaatagtagtgtggactttagtatttatagaatataagaaattgagaaggcaaaggagaatagacagcttgtacaatagaataagagaaagagcagaagacagtggcaatgagagtgatggggatgcagaggaattatccacacttgtgggaatggggaactttgatccttgggttggtgataatctgtagtgcctcaaacaacttgtgggtcacagtttattatggggtacctgtgtggagagacgcagagaccaccctattttgtgcatcagaagctaaagcatatgagaaagaagtacataatatctgggctacacatgcctgtgtacccacagaccccaacccacaagaagtagctctgataaatgtaacagagaactttaacatgtggaaaaatgacatggtagaacagatgcatgaggatataatcagtttatggaatgaaggcctaaaaccatgtgcaaagctaacctctctctgtgttacttttacatgtattaatgcaactactactaatagtaccaatggcactgtgattaaagaaggaataaaaaactgctctttcgatataaccacagaaataagggataagaagaagaaagaatatgcgcttttctatagaattgatatagtgccaattaatgctagagtgccaattaatggtagtaataggaataatagtacagaagagtatatgttaataaattgtaacgcctcaaccattaaacaggcttgcccaaaggtgtcttttgagccaattcccatacattattgtgccccagctggttttgcaattttaaagtgtaatgagaaaaatttcactggattagggccatgcacaaatgtcagctcggtacgatgcactcatggaattaagccagtggtatcaactcaattgctgttaaatggaagcttagcaacggaagaggtagtaattagatctaaaaatatcacagacaataccaaaaatataatagtacagcttgcaaaggctgtaaaaattaattgtaccagacctggcaacaatacaagaaaaagtgtacatatagggccaggactaacatggtatgcaacaggtgaaataataggagatataagacaagcacattgtaacattagtggaaatgattggaatgacaccttaaaagtgataagtgaagaattgaaaagactcttccctaataaaacaataaaatttgctccacccgtaggaggggacctagaaattacaacacatagctttaattgtaaaggagaatttttctattgcaatacaacaccactgtttaatagtacacacatgcaaaatggtacaaacattacaagtacagattctacaaattcaaccatcacactccaatgcagactaaaacaatttgtaaggatgtggcaggaagtggggcaagcaatgtacgcctcccccattgcagggagcattaactgcagctcagatattacaggaataatattgacaagagatggtggtactaataatactgagatcttcagacctggaggaggagacatgagggacaattggagaagtgaactatataaatataaagtagtaaagattgaaccaataggagtagcacccaataaggcaaggagacgagtggtgcagagagaaaaatgagcagtgggaataggggccatgttccttgggttcttgggagcagcaggaagcactatgggcgcagcgtcaatgacgctgacggtacaggccagacaattattgtccggcatagtgcagcagcagagcaatttgctgagggctatagaggctcaacaacatctgttgagactcacggtctggggcattaaacagctccaggcaagagtcctggctctggaaagctacctaaaggatcaacagctcctaggaatttggggctgctctggaaaactcatctgcaccactaatgtaccttggaactctagttggagtaataaatcttataatgatatatgggacaatatgacctggttgcaatgggataaagaaattaacaattacacacaaataatatatgggttacttgaagaatcacagaaccagcaggaaaagaatgagcaagacttattggccttggacaagtgggcaagcctgtggaattggtttagcataacaaaatggctatggtatataaaaatatttataatgatagtaggaggcttgataggcttaagaataatttttgctgtgctttctatagtaaatagagttaggcagggatactcacctttgtctttgcagacccttatcccaacaacccaacggggactcgacaggcccggaggaacagaagaagaaggtggcgagcaagacagaagcagatccattcgcttagtgaacggattcttgccacttatctgggacgacctgcggaacctgtgcctcttcagctaccgccacttgagaaacttactcttaattgtagcgaggactgtggaacttctggggataagggggtgggaagccctcaagtatctgtggaacttcctgctgtattggggacaggagctaaagaatagtgctattaatttgtttaataccacagcaatagcagtagctgagggaacagataggattatagaagcagtacagagagcttgtagagctatttgcaacatacctagaagaatcagacagggccttgaaagagctttgctttaaaatgggaggcaaatggtcaaaaagtagcatagttggatggcctgagataagggaaagaatgaggcgagctcgagctgagccagaaagaatgaggcgagctcaagctgagccagcagcagcaggagtaggagcagtgtctcaagacttggacaaacatggggcaatcacaattaacaatacagcagctactaatcctgacaaaacctggctggaagcacaagaagaggaagaagaggtaggttttccagtcaggccacaggtacctttaaggccaatgacctttaaaggagctttagatctcagccactttttaaaagaaaaggggggactggatgggctaatttactccaagaaaagacaagagatccttgatctgtgggtctatcacacacaaggtttcttccctgattgggataactacacaccaggaccaggggagagattcccactgtgctttggatggtgcttcaagctagtaccagtagatccacaggaggtggaagaggccactgaaggagagaacacctgtttgctgcaccctataagccagcatggaatggaggatgaagagagagaagtattaaagtggaagtttgacagtcgcctggcatacaagcacgtagcccgagagctgcatccggagttttacaaagactgctgacacagaagttgctgacaaagggactttccgcccgggactttccaggggaggcgcggcctgggaggggttggggagtggctaaccctcagatgctgcataaaagcagccgcttctcgcctgtactgggtctctctggttagaccagatctgagcctgggagctctctggctagctagggaacccactgcttaagcctcaataaagcttgccttgagtgcttc

SEQ ID NO: 8 - DNA, 9010 bp, Human immunodeficiency virus type 1
  isolate=96ZM651; 137..1621:"gag"; 1426..4425:"pol"; 4370..4948:"vif"; 4888..5178:"vpr"; 5159..5373-7734..7824:"tat"; 5298..5373-7734..7981:"rev"; 5387..5647:"vpu"; 5565..8171:"env"; 8173..8793:"nef"
cttgaagcgaaagtagaccagaggagatctctcgacgcaggactcggcttgctgaagtgcactcggcaagaggcgagagcggcggctggtgagtacgccaaattttatttgactagcggaggctagaaggagagagatgggtgcgagagcgtcaatattaagagggggaaaattagataaatgggaaaaaattaggctaaggccagggggaaagaaacgctatatgataaaacacctagtatgggcaagcagggagctggaaagatttgcgcttaaccctggccttttagaaacatcagaaggctgtaaacaaataatgaaacagctacaaccagctcttcagacaggaacggaggaacttagatcattatacaacacagtagcaactctctattgtgtacatgaaggggtagaggtacgagacaccaaggaagccttagacaggatagaggaagaacaaaacaaaattcagcaaaaaatacagcaaaaaacacagcaagcggctgacggaaaggtcagtcaaaattatcctatagtgcagaatctccaagggcaaatggtacaccagaaactatcacctagaactttgaatgcatgggtaaaagtaatagaagaaaaagcttttagcccagaggtaatacccatgtttacagcattatcagaaggagccaccccacaagatttaaacaccatgttaaatacagtggggggacatcaagcagccatgcaaatgttaaaagatactatcaatgaggaggctgcagaatgggatagattacatccagtgcatgcagggcctattgcaccaggccaaatgagagaaccaaggggaagtgatatagcaggaactactagtaccctccaagaacagatagcatggatgacaagtaatccccctattccagtgggagacatctataaaagatggataattctggggttaaataaaatagtaagaatgtatagccctgtcagcattttggacataaaacaagggccaaaggaaccctttagagactatgtagaccggttcttcaaaactttaagagctgaacaggctacacaagaagtaaaaaattggatgacagacaccttgttggtccaaaatgcaaacccagattgcaagaccattttaaaagcattaggaccaggggctacattagaagaaatgatgacagcatgtcaaggagtgggaggacctagccacaaagcaagagtgttggctgaggcaatgagccaaacaaatagtgtaaacatactgatgcagaaaagcaattttaaaggaaataaaagaatggttaaatgttttaactgtggtaaggaagggcacatagccagaaattgcagggcccctaggaaaaagggctgttggaaatgtggaaaggagggacaccaaatgaaagactgtactgagaggcaggctaattttttagggaaaatttggccttcccacaagggaaggccagggaatttccttcagaacaggccagagccaacagccccaccagcagagagcttcaggttcgaggagacaacccccgctccgaagcaggagtcgaaagacagggaagccttaacttccctcaaatcactctttggcagcgaccccttgtctcaataaaggtagggggccaaataaaggaggctctcttagacacgggagcaggtgatacagtattagaagaaataaatttgccaggcaaatggaaaccaaaaatgataggaggaattggaggctttatcgaagtaagacaatatgatcaaatacctatggaaatttgtggaaaaaaggctataggtacagtattagtaggacctacacctgtcaacataattggaagaaatatgttgactcagcttggatgcacactaaattttccaattagtcctattgaaactgtaccagtaaaattaaagccaggaatggatggcccaaaggttaaacaatggccattgacagaagagaaaataaaagctttaacagcaatttgtgaagaaatggagaaggaaggaaaaattacaaaaattgggcctgaaaatccatataacactccagtatttgccataaaaaagaaggacagtactaagtggcgaaaattagtagatttcagggaactcaataaaagaactcaagacttttgggaagttcaattaggaataccacacccagcagggttaaaaaagaaaaaatcagtgacagtactggatgtgggggatgcatatttttcagttcctttagatgaaagcttcaggaaatatactgcattcaccatacctagtacaaacaatgaaacaccagggattagatatcaatataatgtgcttccacagggatggaaaggatcaccagcaatattccagagtagcatgacaaaaatcttagagcccttcagggcacaaaatccagacatagtcatctatcaatatatggatgacctgtatgtaggatctgacttagaaatagggcaacatagagcaaaaatagaagagttaagagaacatctattaaagtggggatttaccacaccagacaagaaacatcagaaagaacccccatttctttggatggggtatgaactccatcctgacaaatggacagtacagcctatacagctggcagaaaaagatagctggactgttaatgatatacagaagttagtgggaaaattaaactgggcaagtcagatttacgcagggattaaagtaaggcaactttgtaaactccttaggggagccaaagcactaacagacatagtaccactaactgaagaagcagaattagaattggcagagaacaaggaaattttaaaagaaccagtacatggggtatattatgacccatcaaaagacttgatagctgaaatacagaaacaagggcatgaccaatggacatatcaaatttaccaggaaccattcaaaaatctgaaaacagggaagtatgcaaaaatgaggacagcccacactaatgatgtaaaacagttaacagaggcagtgcaaaaaatagccctggagagcatagtaatatggggaaagattcctaaatttagactacccatccaaaaagaaacatgggaaacatggtggacagactattggcaagccacctggattcctgagtgggagtttgttaatacccctctcttagtaaaattatggtaccagctggagaaagaacccatagtaggagcagaaaccttctatgtagatggagcagccaatagggaaactaaattaggaaaagcagggtatattactgacagaggaaggcaaaaaattgttactctaactgaaacaacaaatcagaagactgaattacaagcaatttacctagctttgcaagattcaggatcagaagtaaacatagtaactgactcacagtatgcgttaggaatcattcaagcacatccagataagagtgaatcagagttagtcaaccaaataatagaacaattaataaagaaggaaagggtctacctgtcatgggtaccagcacataaaggaattggaggtaatgaacaggtagataaattagtaagcaagggaatcaggaaagtgctgtttctagatggaatagacaaggctcaagaagagcatgaaaaatatcacaacaattggagagcaatggctagtgaatttaatctaccaccagtagtagcaaaagaaatagtagctagttgtgataaatgtcagcaaaaaggggaagccacacatggacaagtagactgtagtccagggatatggcaattagactgtacacatttagaaggaaaaatcatcctggtagcagtccatgtagccagtggctacatagaagcagaggttatcccagcagaaacaggacaagaaacagcatactatatattaaaattagcaggaagatggccagtcaaagtaatacatacagacaatggtagcaattttaccagtgctgcagttaaggcagcctgttggtgggcaggtatcaaacaagaatttggaattccctacaatccacaaagtcagggagtagtagaatccatgaataaagaattaaagaaaatcatagggcaggtaagagatcaggctgagcatcttaaaacagcagtacaaatggcagtattcattcacaattttaaaagaaaaagggggattggggggtacagtgcaggggaaagaataatagacataatagcaacagacatacaaaccaaagaactacaaaaacaaattataaacattcaaaaatttcgggtttattacagagacagcagagaccccatttggaaaggaccagccaaactactctggaaaggtgaaggggcagtagtaatacaagataatagtgacataaaagtggtaccaaggaggaaagcaaaaatcattagggactatggaaaacagatggcaggcgctgattgtgtggcaggtagacaggatgaggattagaacatggaatagtttagtaaagcaccatatgtatatttcacggaaagctaatggatggttttacagacatcattatgaaagcagacatccaagggtaagttcagaagtacatatcccattaggggatgctaaattagtaataaaaacatattggggtttgcaaacaggagaaagagattggcatttgggtcatggagtctccatagaatggagattgagaagatatagcacacaagtagaccctggcctggcagaccagctaattcatatgcactattttgattgttttgcagactctgccataagaaaagccatattaggacacatagttattcctaggtgtgactatcaagcaggacataataaggtaggatctctgcaatacttggcactgacagcattgataaaaccaaaaaagagaaagccacctctgcctagtgttaggaaattagtagaggatagatggaacaattcccagaagaccaagggccgcagagggaaccatacagtgagtggacactagagattctagaggaactcaagcaggaagctgtcagacactttcctagaccatggctccatagcttaggacaacatatctatgaaacttatggggatacttggactggagtcgaggctataataagaatactgcaacaactactgtttattcatttcagaattgggtgccagcacagcagaataggcatggttcgacagagaagagcgagaaatggagccagtagatcctagcatagagccctggaaccatccaggaagtcagcctaaaactgcttgtaataagtgttattgcaaacgctgtagctatcattgtctagtttgctttcagacaaaaggcttaggcatttcatatggcaggaagaagcggagacagcgacgcagcactcctcctagcagcgaggaccatcaagatcctatatcaaagcagtaagtatatgtaatgttagatttactagcaagagtaaattatagagtaggagtaggagcattgatagtagcactactcatagcaatagttgtgtggaccatagcatatatagaatataggaagctgttaagacaaagaaaaatagactggttaattaaaagaattagggaaagagcagaagacagtggcaatgagagtgagggagatactgaggaattggcaacgatggtggacatggggcatcttaggcttttggatgttaatgatttgtaatgtgtgggggaacttgtgggtcacagtctattatggggtacctgtgtggaaagaagcaaaaactactctattctgtgcatcagatgctaaatcatatgagaaagaagtgcataatgtctgggctacacatgcctgtgtacccacagaccccaacccacaagaaatagttttgggaaatgtaacagaaaattttaacatgtggaaaaatgacatggtggatcagatgcatgaggatataatcagtttatgggatcaaagcctaaagccatgtgtaaagttgaccccactctgtgtcactttaaattgtacagaggttaatgttaccagaaatgttaataatagcgtggttaataataccacaaatgttaataatagcatgaatggagacatgaaaaattgctctttcaacataaccacagaactaaaagataagaaaaagaatgtgtatgcacttttttataaacttgatatagtatcacttaatgagactgacgactctgagactggcaactctagtaaatattatagattaataaattgtaatacctcagccctaacacaagcctgtccaaaggtctcttttgacccaattcctatacattattgtgctccagctggttatgcgattctaaagtgtaataataagacattcaatgggacaggaccatgccataatgtcagcacagtacaatgtacacatggaattaagccagtggtatcaactcaactactgttaaatggtagcctagcagaagaagggataataattagatctgaaaatctgacaaacaatgtcaaaacaataatagtacatcttaatagatctatagaaattgtgtgtgtaagacccaacaataatacaagacaaagtataagaataggaccaggacaaacattctatgcaacaggagacataataggagacataagacaagcacattgtaacattagtaggactaactggactaagactttacgagaggtaaggaacaaattaagagaacacttccctaataaaaacataacatttaaaccatcctcaggaggggacctagaaattacaacacatagctttaattgtagaggagaatttttctattgcaatacatcgggcctgtttagtataaattatacagaaaataatacagatggtacacccatcacactcccatgcagaataagacaaattataaatatgtggcaggaagtaggacgagcaatgtacgcccctcccattgaaggaaacatagcatgtaaatcagatatcacagggctactattggttcgggatggaggaagcacaaatgatagcacaaataataacacagagatattcagacctgcaggaggagatatgagggacaattggaggagtgaattgtataagtataaagtggtagaaattaagccattgggaatagcacccactgaggcaaaaaggagagtggtggagagagaaaaaagagcagtgggaataggagctgtgttccttgggttcttgggagcagcaggaagcactatgggcgcagcgtcaataacgctgacggcacaggccagacaagtgttgtctggtatagtgcaacagcaaagcaatttgctgagggctatagaggcgcaacagcatctgttgcaactcacggtctggggcattaagcagctccagacaagagtcctggctatagaaagatacctaaaggatcaacagctcctaggactttggggctgctctggaaaactcatctgcaccactgctgtgccttggaacatcagttggagtaataaatctaaaacagatatttgggataacatgacctggatgcagtgggatagagaaattagtaattacacaaacacaatatacaggttgcttgaggactcgcagagccagcaggagcaaaatgaaaaagatttattagcattggacagttggaacaatctgtggaattggtttgacataacaaaatggctgtggtatataaaaatatttataatgatagtaggaggcttaataggtttgagaataatttttgctgtactctctatagtgaatagagttaggcagggatactcacctttgtcgtttcagacccttatcccgaacccaagggaacccgacaggccaggaagaatcgaagaagaaggtggagagcaagacaaagagagatccgtgcgattagtgagcggattcttagcacttgcctgggacgacctacggagcctgtgcctcttcagctaccaccgattgagagacttcatattggtgacagcgagagcggtggagcttctgagacgcagcagtctcaagggactacagagggggtgggaagcccttaagtatctgggaagtcttgtgcagtattggggtctggagctaaaaaagagtgctattagtctacttgataccatagcaatagcagtagctgaaggaacagataggattatagaattaatacaaggaatttgtagagctatccgcaacgtacctagaagaataagacagggctttgaaacagctttgctataaaatggggggcaagtggtcaaaaagcagtatagttggatggcctgctgtaagagagagaataagaagaactgagccagcagcagagggagtaggagcagcgtctcaagacttagataaatatggagcacttacaagcagcaacacaagtaccactaatgctgcttgtgcctggctggaagcacaagaggaggaagaagttggctttccagtcagacctcaggtgcctttaagaccaatgacttataaggcagcagtcgatctcagcttctttttaaaagaaaaggggggactggaagggttaatttactctaagaaaaggcaagaaatccttgatttgtgggtctatcacacacaaggcttcttccctgactggcaaaactacacaccgggaccaggggtcagatatccactgacctttggatggtgcttcaagctagtgccagttgatccaggggaagtagaagaggccaacgaaggagaaaacaactgtctgctacaccctatgagccagcaaggaatggatgatgatcacagagaagtattaaagtggaagtttgacagtcacctagcacataaacacatggcccgagagctacatccggagtattacaaagactgctgacacagaagggactttccgctgggactttccactggggttccaggaggtgtggtctgggcgggactggggagtggtcaaccctcagatgctgcatataagcagctgcttttcgcttgtactgggtctctctaggtagaccagatctgagcctgggagctctctggctatctagggaacccactgcttaagcctcaataaagcttgccttgagtgctct

SEQ ID NO: 9 - DNA, 8972 bp, Human immunodeficiency virus type 1
  isolate=96ZM751.3; 137.1632:gag; 1419.4435:pol; 4380.4958:vif; 4898.5188:vpr; 5169.7814:tat; 5308.7938:rev; 5407.5667:vpu; 5585.8128:env; 8130.8753:nef
ccgaaagcgaaagtaagaccagaggagatctctcgacgcaggactcggcttgctgaagtgcactcggcaagaggcgagagcggcggctggtgagtacgccaattttatttgactagcggaggctagaaggagagagatgggtgcgagagcgtcaatattaagaggcggaaaattagatgaatgggaaagaattaggttaaggccagggggaaaaaagcactatatgatgaaacacttaatatgggcaagcagggagctggaaagatttgcacttaaccctggccttttagagacatcagaaggctgtaaacaaataatacaacagctacaaccagctctccagacaggaacagaggaacttaggtcattatataatacagtagcaactctctattgtgtacatgaaaagataaaggtacgagacaccaaggaagccctagacaagatagaggaagaacaaaacaaaagtcaacaaaaaatacaaaaaacagaagcgactggcggaaaggtcagtcaaaattatcctatagtgcagaatctccaagggcaaatggtacaccaggctatatcacctagaactttgaatgcatgggtaaaagtaatagaggagaagggtttcaacccagaggtaatacccatgtttacagcattatcagaaggagccaccccacaagatctaaacaccatgttaaatacagtggggggacatcaagcagccatgcaaatgttaaaagataccatcaatgaggaagctgcagaatgggataggttacatccagtacatgcagggcctattgcaccaggccaaataagagaaccaaggggaagtgacatagcaggaactactggtacccttcaggaacaaatagcatggatgacaaataacccacctattccagtgggagacatctataaaagatggataattctggggttaaataaaatagtaagaatgtacagccctgtcagcattctggacataaaacaaggaccaaaggaaccctttagggactatgtagatcggttctttaaaactttaagagctgaacaagctacacaagatgtaaaaattggatgacagacaccttgttggttcaaaatgcgaacccagattgtaagaccattttaagggcattaggaccaggggctacattagaagaaatgatgacagcatgtcagggagtggggggacctggccacaaagcaagagttttggctgaagcaatgagccaagtaaacaatacaaacataatgatgcagaaaagcaattttaaaggccctaaaagaattgttaaatgtttcaactgtggcagggaagggcatatagccaggaattgcagggctcctgggaaaaaaggctgttggaaatgtggaaaggaaggacaccaaatgaaagactgtactgagagacaggctaattttttagggaaaatttggccttcccagaaggggaggccggggaacttccttcagaacagaccagagccaacagccccaccagctccaacagccccaccagcagagagcttcaggttcgaggagacaacccctgccccgaggcaggagcagaaagacaaggaacccttaactgccctcaaatcactctttggcagcgaccccttgtctcaataaaagtagggggtcagataaaggaggctctcttggatacaggagcagatgatacagtattagaagaaataaatttgccaggaaaatggaaaccaaaaatgataggaggaattggaggttttatcaaagtaagacagtatgatcaaatacttatagaaatttgtggaaaaaaggctataggtacagtattagtaggacctacacctgtcaacataattgggagaaatatgttgacccagcttggctgcacactaaattttccaattagtcctattgaaactgtaccagtaaaattaaagccaggaatggatggcccaagggtcaaacaatggccattgacagaagaaaaaataaaagcattaacagcaatttgtgaagaaatggaaaaggaaggaaaaattacaaaaattggccctgagaatccatataacactccagtatttgccataaaaaagaaggacagtactaagtggagaaaattagtagatttcagggaactcaataaaagaactcaggacttttgggaagttcaattaggaataccacacccagcggggttaaaaaagaaaaagtcagtgacagtactggatgtgggggatgcgtatttttcagttcctttagatgaaggcttcaggaaatatactgcattcaccatacctagtataaacaatgaaacacctgggattagatatcaatataatgtgcttccacagggatggaaaggatcaccatcaatattccagagtagcatgataaaaatcttagagccctttaggacacaaaacccagaaatagttatctatcaatatatggatgacttgtatgtaggatctgatttagaaatagggcaacacagagcaaaaatagaggagttaagagaacacctattgagatggggatttactacaccagacaagaagcatcagaaagagcccccatttctttggatggggtatgaactccatcctgacaaatggacagtacagcctataaagctgccagaaaaggagagctggactgtcaatgatatacagaagttagtgggaaaattaaactggcaagtcagatttacgcagggattaaagtaaggcaactgtgtaaactccttaggggagccaaagcactaacagacatagtaccattgactgaagaggcagaattagaattggcagagagcagggaaattctaaaagaaccagtacatggagtatattatgacccatcaaaagacttaatagctgaaatacagaaacaagggcatgaccaatggacatatcaagtttaccaagaaccattcaaaaatctgaaaacaggaaagtatgcaaaaatgaggactgcccacactaatgatgtaaaacagttaacagaggcggtgcaaaaaatagccatggaaagcatagtaatatggggaaagattcctaaatttaggctacccattcaaaaagaaacatgggagacatggtggacagactattggcaagccacctggattcctgagtgggagtttgttaatactccccccctagtaaaattatggtaccagctggagaaagaacccatagcaggagcagaaacttactatgtagatggagcagccaatagggaaactaaaataggaaaagcagggtatgttactgacagaggaaggcaaaaaattgttactctaactgaaacaacaaatcaaaagactgaattacaagcaattcagttagctttgcaggattcaggatcagaagtaaacatagtaacagactcacagtatgcattaggaatcatccaagcacaaccagataagagtgaatcagaattagtcaatcaaataatagaacagttgataaaaaaggaaagggtttacctgtcatgggtaccagcacacaaaggaattggaggaaatgaacaagtagataaattggtaagtagtggaatcaggaaagtgctgtttctagatggaatagataaggctcaagaagagcatgaaaaatatcacagcaattggagagcaatggctagtgagtttaatctgccacccatagtagcaaaagaaatagtagccagctgtgataaatgtcagctaaaaggggaagccatacatggacaagtagactgtagtccaggaatatggcaattagattgtacccatttagaaggaaaagtcatcttggtagcagtccatgtagccagtggttacatagaagcagaggtcaccccagcggaaacaggacaagaaacagcacttttcatactaaaattagcaggaagatggccagtcaaagtagtacatacagacaatggcagtaatttcaccagtgctgcagtcaaggcagcctgttggtgggcaggtatccaccaggaatttggaattccctacaatccccaaagtcaaggagtagtagaatccatgaataaagaattaaagaaaattatagggcaggtaagagatcaagctgagcaccttaagacagcagtacaaatggcagtattcattcacaattttaaaagaaaaggggggattggggggtacagtgcaggggaaagaataatagacataatagcaacagacatacaaactagagaattacaaaaacaaattataaaaattcaaaattttcgggtttattacagagacagcagagaccctatttggaaaggaccagccaaactactctggaaaggtgaaggggcagtagtaatacaagataatagtgacataaaggtaataccaaggaggaaagcaaaaatcattagggactatggaaaacagatggcaggtactgatagtgtggcaggtagacaggatgaagattagaacatggaatagtttagtaaagcaccatatgtatgtttcaaaaagaactggtagatggttttacagacatcattatgaaagcagacatccaaaaataagttcagaagtacacatcccattaggggatgccaaattagtaataaaaacatattgggggctgcatccaggggaaagagaatggcatttgggtcatggagtctccatagaatggagattgagaagatacagcacacaagtagaccctggcctggcagaccagctaattcatatgcattattttaattgttttgcagactctgccataagaaaagccctactaggacatatagttattcctaggtgtgattatcaagcaggacataataaggtaggatccctacaatacttggcactgacagcattgataaaaccaaaaaagataaagccacctttacctagtgttaggaaattagtagaggatagatggaacaagccccagaaaaccaagggccgcagagggaaccatataatgaatgggcactagagcttttagaggagctcaagcaggaagctgtcagacactttcctagaacatggctccataacttaggacaacatatctaccaaacctacggggatacttggacgggggttgaagctctaataagaatactgcaacaactactgtttattcatttcagaattggatgccaacatagcagaataggcattatgcgacagagaagagcaagaaatggagccagtagatcctagactagagccctggaatcatccaggaagtcaacctaaaactccttgtaataagtgttattgtaaacactgtagctatcattgtctagtttgctttcagacaaaaggcttaggcatttcctatggcaggaagaagcggagacaacgacgaagcgctcctccaagcagtgaggatcatcaaaatcctatatcaaagcagtaagtacaaagtaatagatgtaatgttaaatttagaagcaagagtagattatagaataggagtaggagcattaatagcagcactaatcatagcaatagctgtgtggatcatagtatatatagaatatagaaaattgtcaagacaaagaaaaatagaccggttaattaaaagaattagagaaagggcagaagacagtggcaatgagagtgaaggggataatgaggaattggcaacaatggtggatatggggcatcttaggcttttggatgctattgatgtgtaatgcaatggggaaattgtgggtcacagtctactatggggtacctgtgtggaaagaagcaaaaactactttattttgtgcatcagatgctaaagcatatgagacagaagtgcataatgtttgggctacacatgcctgtgtacccacagaccccaacccacaagaaatggttttggaaaatgtaacagaaaagtttaacatgtgggaaaataacatggtggatcagatgcatgaggatataatcagtttatgggaccaaagcctaaagccatgtgtaaagttgaccccactctgtgtcactttaaactgtactgctaatataaccaacaatgctaatataaccaacaatgctaatataaccaactataataatgaaactgacatgagaaattgctctttcaatataaccacagaattaagagataagaggaggcaagtagatgcactcttttataaacttgatatagtaccaattaatgagaattccagtgaatatagattaataaattgtaatacctcggccataacacaagcatgtccaaaggttacttttgacccaatccctatacattattgtgctccagctggttatgcgattctaaagtgtaacaataagacattcaatggaacaggaccatgcaataatgtcagcacagtacaatgtacacatggaattaagccagtagtatcaactcaattactgttaaatggtagtctagcagaagaagagataataattagatctaaaaatatgacagacaatgccaaaataataatagtacatcttaatgaatctgtagaaattgtgtgtacaagacccaacaataatacaaggaaaagtgtgaggataggaccaggacaaacattctatgcaacaggagaaataataggaaatataagacaagcatattgtaacatcagtgaaggcaaatggaataacactctacaaagggtaggtgaaaaattaagaaaatacttccctaataaaacaataagctttgcaccatcctcaggaggggacctagaaattacaacacatagctttaattgtagaggagaatttttctattgcaatacatcaaaactgtttaatggtacgtttaatggtacaaacacttctaatgatagaagtaattcgaccattacgcttcaatgcagaataaaacaaattacaaacatgtggcagggggtaggacaagcaatgtatgctcctccaattaaaggaaacataacatgtaaatcaaatatcacaggactactattaacacgtgatggagggacaaatgacacagagacaccagagacattcagacctggaggaggagacatgaaggacaattggagaagtgaattatataaatataaagtggtagaaattaagccattaggagtagcacccactaaggcacgaaggagagtggtggagagagaaaaaagagcagtaggaataggagctgtgttccttgggttcttgggagcagcaggaagcactatgggcgcagcatcaataacgctgacggtacaggtcagacaattattgtctggtatagtgcaacagcaaagcaatttgctgagggctatagaggcgcaacagcacatgttgcaactcacagtctggggcattaagcagctccaggcaagagtcttggctatagaaagatacctaaaggatcaacagctcctagggatttggggctgctctggaaaactcatctgcaccactgctgtgccttggaactctagttggagcaacaaatctgaacgggagatttgggataacatgacctggatgcagtgggatagagaaattaataattacacagaaacaatatataggttgcttgaagtctcgcaaaaccagcaggaaaataatgaaagggatttactagcattggacagttgaaaaaatctgtggaattggtttaatataacaaattggctgtggtatataaaaatattcataatgataataggaggcttgataggtttaagaataatttttgctgtgctctctatagtaaatagagttaggcaggggtactcacctttgtcgttgcagacccttatcccaaccccgagggaaccagacaggctcggaagaatcgaagaagaaggtggagagcaagacagagacagatcaattcgattagtgaacggattcttagcacttgtctgggacgacctccggagcctgtgccttttcagctaccaccgcttgagagacttcatattgattgcagcgaggggactacagagggggtgggaaactcttaagtatctggggagtcttgtacagtattggggtctagagctaaaaaagagtgctattagtttgcttgatactatagcaatagcagtagctgaaggaacagatagaattatagaattaacacaaagaatttgtagagctatccgcaacgtacctagaagaataagacagggctttgaagcagctttgcaataagatgggaggcaagtggtcaaaacgcagtatagttggatggcctaaagtaagagaaagaatagcaagaactgatccagcagcagagggagtaggagcagcgtctcaagacttagataaatatggggcacttacaagcagtaacacaagtaccaataatgctgattgtgcctggctggaagcgcaagaggaggagggagaagtaggctttccagtcagacctcaggtacctttaagaccaatgacttataagtcagcatttgatctcagcttctttttaaaagaaaaggggggactggatgggttaatttactgtaagaaaagacaagaaatcctcgatttgtgggtctatcacacacaaggctacttccctgattggcaaaactatacaccgggaccagggatcagatatccactgacctttggatggtgctacaagctagtgccagttgacccaagggaagtagaagaagccaacgaaggagaggacaactgtttgctacaccctataagccagcatggaatagaagatgaagacagagaagtattaaggtggaagtttgacagttccctagcacgcagacacatggcccgcgagctacatccggagtattacaaagactgctgacacagaagggactttccgctgggactttccactggggcgttccagggggtgtgatctgggcgggactggggagtggccagccctcagaagctgcatataagcagctgcttttcgcctgtactgggtctctctaggtagaccagatctgagcccgggagctctctggctatctagggaacccactgcttaagcctcaataaagcttgccttgagtgcctt

SEQ ID NO: 10 - DNA, 9060 bp, Human immunodeficiency virus type 1
  isolate=94CY017.41; 159.1649:"gag"; 1442.4453:"pol"; 4398.4976:"vif"; 4916.5206:"vpr"; 5187.7841: "tat"; 5326.8046:"rev"; 5428.5673:"vpu"; 5591.8188:"env"; 8190.8843:"nef"
ttgaaaagcgaaagtaacagggactcgaaagcgaaagttccagaggagttctctcgacgcaggactcggcttgctgaggtgcacacggcaagaggcgaggggcggcgactggtgagtacgcctaatatttttgactagcagaggctagaaggagagagatgggtgcgagagcgtcaatattaagcgggggaaaattagatgcttgggagaaaattcggttaaggccagggggaaagaaaaaatatagactgaaacatttggtatgggcaagcagggagctggagaaattctcaattaaccctggccttttagaaacaccagagggatgtagacaaataataaggcagttacaaccagctctccaaacaggaacagaagaacttaaatcattatataatacagtagtagtcctctactgggtacatcaaagggtagatgtaaaagacaccaaggaagctctagataaaatagaggaagaacaaaacaagcagaaaacacagcatgcagcagctgacacagggaacagcagcagtcaaaattatcccatagtgcaaaatgcacaagggcaaatggtacaccaggctatatcacctaggacgttgaatgcctgggtcaaagtagtagaagaaaaggctttcagcccagaagtaatacctatgtttacagcattatcagaaggagccaccccacaagacttaaatactatgctaaacacagtggggggacatcaagcagctatgcaaatgttaaaagataccatcaatgaggaagctgcagaatgggacagggtacatccagtacatgcagggcctattccaccaggccagatgagagaaccaaggggaagtgacatagcaggaactactagtacccttcaggaacaaataggttggatgaccagcgatccacccatcccagtgggagaaatttataaaagatggataatcctgggattaaataaaatagtaagaatgtatagccctgtcagcattttggacataagacaagggccaaaagaaccctttagagattatgtggataggttctttaaaactctaagagctgagcaagccacacaggaggtaaaaaactggatgacggacaccttgctggtccaaaatgcgaacccagattgtagatccatcttgagagcattaggaccaggggcctcattagaagaaatgatgacagcatgtcagggagtgggaggacccagccataaagcaagggttttggctgaagcaatgagccatgtacaaagtacaaatacaaacataatgatgcagagaggcaattttaggggtcaaaaaagaattaagtgtttcaactgtggcaaggaaggacacctagccagaaattgcagggcccctaggaaaaagggctgctggaaatgtggaaaggaaggacatcaaatgaaagattgcactgagagacaggctaattttttagggaaaatttggccttccaacaaagggaggccaggaaattttcctcagagcagaacagagccaacagccccaccagcagagaacttgagaatgggggaagagataacctcctccctgaagcaggaactggagaccagggaaccatacaatcctgcaatttccctcaaatcactctttggcaacgaccccttgttacagtaaagatagagggacagctaaaagaagctctattagatacaggagcagatgatacagtgttagaagaaataaatttgccaggaaaatggaaaccaaaaatgatagggggaattggaggttttatcaaagtaagacaatatgatcagatagctatagaaatttgtggaaaaagggccataggtacagtattagtaggacctacccctgtcaacataatcggaagaaatatgttggttcagcttggttgtactttaaattttccaattagtcctattgaaactgtaccagtaaaattaaagccaggaatggatggtccaaaggttaaacaatggccattgacagaagaaaaaataaaagcattaacagaaatctgtaaagaaatggaaaaggaaggaaaaatttcaaaaattgggcctgaaaatccatacaacactccagtgtttgctataaagaaaaaagacagcactaaatggagaaaattagtagattttagagaactcaataagagaactcaagacttctgggaagttcagttaggaataccacatccagcaggattaaaaaagaaaaaagcagtaacagtacttgatgtgggggacgcatatttttccgttcccttacatgaagacttcagaaaatatactgcattcaccatacctagtaccaacaatgagacaccaggagttaggtatcagtacaatgtacttccacagggatggaaaggatcaccagcaatattccagagtagcatgacaaagatcttagagccctttagatcaaagaatacagaattaatcatctaccaatacatggatgacttgtatgtaggatctgatttagaaataagccagcatagagtaaaaatagaggaattaagggctcacttattgaaatggggattttatacaccagacaaaaaacatcagaaagaacctccatttctttggatgggatatgagcttcatcctgacaaatggacagtccagcctataaagctgccagaaaaagacagctggactgtcaatgatatacagaaattagtagggaaattaaattgggcaagtcagatttatgcagggattaaagtaaagcaactgtgtaaactccttagaggagccaaagcactaacagacatagtaacactgactaaagaagcagagttagaattagaagagaacagggaaattttaaaaacccctgtacatggggtatactatgacccatcaaaagacttaatagcagaaatacagaaacaagggcaagaccaatggacatatcaaatttatcaggaaccctttaagaatctgaaaacagggaaatatgcaaaaaggaggtccacccacactaatgatataaaacagttaacagaagcagtacaaaaaataaccatggaaagcatagtgatatggggaaagactcctaaatttaaattacccatacaaaaggaaacatgggagacatggtgggcggagtattggcaggctacctggattcctgagtgggagtttgtcaatacccctcctctagtaaaactgtggtaccagttagaaaaagaacccatagcaggagcagaaactttctatgtagatggggcagctaatagagagactaaactaggaaaggcagggtatgtcactgacagaggaagacaaaaaattgtctccctgacggagacaacaaatcaaaagactgaattacatgcaatctatttggctttacaggattcaggattagaagtgaacatagtgacagattcacagtatgcattaggaatcattcaagcacaaccagaaaggagtgaatcagagatagtcaatcaaataatagaaaaattaatagaaaaggaaagggtctacctatcatgggtaccagcacacaaagggattggaggaaatgaacaagtagacaaattagtcagttctggaatcaggaaagtgctatttttagatgggatagataaggctcaagaggaacatgaaagatatcacagcaattggagagcaatggctcatgactttaatctaccacctgtagtagcaaaagaaatagtagctagctgtgataaatgtcagctaaaaggggaagccatgcatggacaagtagactgtagtccaggaatatggcaactagattgcacacatcttgaaggaaaagttatcctggtggcagtccatgtggccagtggctatatagaagcagaagtcatcccaacagaaacaggacaggatacagcatactttatattaaaactagcaggaagatggccagtaaaagtaatacatacagacaatgggcccaatttcatcagtgcaacagttaaggcagcctgttggtgggcaggtatccaacaagaatttgggattccctacaatccccaaagtcaaggagtagtggaatctatgaataaagaattaaagaaaatcatagggcaggtaagagatcaagctgaacaccttaagacagcagtacaaatggcagtattcattcacaattttaaaagaaaaggggggattgggggatacagtgcaggggaaagaataatagacataatagcaacagatatacaaactaaagaactacaaagacaaattacaaaaattcaaaattttcgggtttattacagggacagcagagatccaatttggaaaggaccagcaaaactcctttggaaaggtgaaggggcagtagtaatacaagacaatagtgacataaaggtagtaccaagaagaaaagcaaagatcattagggattatggaaaacagatggcaggtgatgattgtgtggcaggtagacaggatgaggattagaacatggaacagtttagttaaacatcatatgtatatttcaaggaaagctaaaggttgggtctataaacatcactatgaaagcagaaatccaagaataagttcagaagtacacatcccgctaggggaggctagaataatagtaagaacatattggggtctgcacataggagaaaaagactggcacttgggtcatggagtctccatagaatggaggcaaaacaggtatcatacacaaatagaccctgatctggcagaccatctaatccatctgtattattttgactgtttttcagaatctgccataaggaaagccataataggagaaatagttagtcctaggtgtgaatatcaagcaggacataacaaggtagggtctctgcaatatttggcattgaaagcagtagtagcttcaacaaggacaaagccacctttgcctagtgttaggaaattagtagaggatagatggaacaagccccagaagaccaagggccacagagggagccatacaatgaatggatgttagaactgttagaggagctcaagcaggaagctgttagacatttccctaggcactggctacatggcctaggacaatacatctataatacctatggggatacctgggaaggagttgaagttatcataagatatctgcaacaactactgtttgtccatttcagaattgggtgccaacatagcaggataggcattattcgaagaagaagagtaagggatggagccagtagaccctaaactagagccctggaaccatccgggaagtcagcctaaaactgcttgtaccaaatgttattgtaaacgctgttgctatcattgccagttgtgctttataaacaaaggcttaggcatctcctacggcaggaagaagcgacgaccccgacgaaagccttctccaagcaataaggaccatcaaaatcctataccaaagcagtaagtagtagtaattaatatatgtaatgttacctttagtaatattggcaatagtaggactgatagtagctttaatcttagcaatagttgtatggactatagtattcatagaatataagaaaattaagaagcaaaggaaaatagactggttaatcaaaagaataagtgagagagcagaagacagtggcaatgagagtgatggggacacagaggaactatcagcacttgtggagagggggcatcttgattttggggatgttaataatgtgtaaagctacagatttgtgggtcacagtatactatggagtacctgtgtggaaagatgcagataccatcctattttgtgcatcagatgctaaagcatatgatacagaagtgcataatgtatgggccacacatgcctgtgtacccacagaccccaacccacaagaaataaacctggaaaatgtaacagaaaattttaatatgtggaaaaataacatggtagagcagatgcaagaagatataatcagcttatgggatcaaagcctaaagccatgtgtaaaattaaccccgctctgcgtcattttaaattgtagcaatgccaataccagcacccatagcaatagcagtagcacccagagccccattaatgaagaaataaaaaactgctcttacaatactaccacaatactaagagataagacacaaaaagtttattcactgttttatagacttgatgtagtacaacttgatgaaagtgaaaataagaatacatcaggtagtaatactctgtatagactaataaattgtaatacctcaaccatcacacaagcgtgtccaaaggtaacctttgagccaattcctatacattattgtgccccagctggttttgcgattctaaagtgtaaggatccgagattcaatggaacagggtcatgcaagaatgttagctcagtacaatgtacacatggaattaaaccagtagcatcaactcaactgctgttgaatggcagtctagcagaaggagggaaaataatgattagatctgaaaatattacaaacaatgccaaaaacataatagttcagtttactaagcctgtactaattacttgtatcagacccaacaacaatacaagaaaaagtatacgctttggaccaggacaagccttctatacaaatgaaataataggggacataagacaagcacattgtaatatcaacaaaacattatggaatgacactttacaaaaggtagctgaacaattaagagagaaattccctaagaaaaccataatctttactaactcctcaggaggggacccagaaattacaacacttagttttaattgtgcaggagaatttttctattgcaatacaacaggcctgtttaatggtacgtggtggaacaatggtacgtggaacgggccctacacacctaataacaccaatggaagtataatcctcccatgcagaataaaacaaattataaacatgtggcagagagtaggaagagcaatgtatgcccctcccattgcaggaataataaagtgtacatcaaacattacaggaataatattgacaagagatggtggtaacaatgggactaatgagaccttcagacctggaggaggagatatgagggacaattggagaagtgaattatataaatataaagtagtaaaacttgaaccactaggagtagcacctaccagggcaaaaagaagagtggtggagagagaaaaaagagcagttggactgggagctgtcttccttgggttcttgggagcagcaggaagcactatgggcgcggcgtcactaacgctgacggtacaggccagacaattattgtctggtatagtgcaacagcaaagcaatttgctgcaggctatagaagctcaacagcatctgttgaaactcacagtctggggcattaaacagctccaggcgagggtcctggctgtggaaagatacctaaaggatcaacagctcctgggaatttggggctgctctggaaaactcatctgcgccactactgtgccctggaacactagttggagtaataagtctcaggatgagatttgggacaacatgacctggttgcaatgggataaagaaattagcaattacacaaacataatatataggttacttgaagaatcgcaaaaccagcaggaaaagaatgagcaagacttattggcattagacaaatgggcagatttgtggagttggttcaacatttcacactggctgtggtatataagaatatttataatgatagtaggaggcttgataggattaagaatagtttttgctataattactgtagtaaatagagttaggcagggatactcacctgtgtcatttcagatccctaccccaagcccagagggtcccgacaggcccagaggaaccgaagaaggaggtggagagcaaggcagagacagatcgattcgattagtgaacgggttcttcgcacttgcctgggacgacctacggagcctgtgcctcttcagttaccaccgcttgagagattgcatattgattgcagcgaggactgtggaacttctgggacactgcagtctcaagggactgagactggggtgggaaggtctcaagaatctgtggaatcttctgttatactggggtcgggaactgaagaatagtgctattagcttatttgatactatagcagtagcagtagctgagtggacagatagggttatagaaatagggcaaagagctttcagagctattctcaacatacctagaagaatcagacagggcttagaaagggctttactataaaatggggggcaagtggtcaaaaaggagcataccaggatggcctgctattagggagagaatgagaagaactcctccaacagcacaaagaacagaagcagtgtctccagcagcaccaggagtaggagcagtgtctcaagatttagctactcatggagcagtcacaagcagtaatacagcagctactaatcctgattgcgcctgggtggaagcgcaagaagaggagagtgaagtaggcttcccagtcaggccacaggtacctttaaggccaatgaccttcaagggagcgtttgatctcagcttctttttaaaagaaaaggggggactggatgggttaatttactcccagaaaagacaagacatccttgatatgtgggtctaccacacacaaggctacttccctgattggcagaattacacaccagggccagggatcagatacccattaacatttggatggtgcttcaagctagtaccagtagagccatctgaggtagaagaagctactcagggagagaacaacagcttattacaccctatatgccaacatggagtagatgaccctgaaagagaagtgttaagatgggagtttgatagaagcctggcacggagacacagagcccgagagctgcatccggagtactacaaagactgctgacacagaagttgctgacggggactttccgctggggactttccagggaggtgtggtgtgggcggagttggggagtggctaaccctcagatgctgcatataagcagctgcttctcgcatgtactgggtctctcttgttggaccagatagagcccgggagctctctggctagcaggggaacccactgcttaagcctcaataaagcttgccttgagagcttc

SEQ ID NO: 11 - DNA, 8959 bp, Human immunodeficiency virus type 1
  isolate=94IN476.104; 138.1613:"gag"; 1418.4428:"pol"; 4361.4939:"vif"; 4879.5169:"vpr"; 5150.7782:tat"; 5289.7939:"rev"; 5378.5638:"vpu"; 5556.8129:"env"; 8131.8754:nef
ttgaaagcgaaagtaagaccagaggagatctctcgacgcaggactcggcttgctgaagtgcactcagcaagaggcgaggggggcgactggtgagtacgccaatttttatttgactagcggaggctagaaggagagagatgggtgcgagagcgtcaatattaagagggggaaaattagatagatgggaaaaaattcggttaaggccagggggaaagaaacattatatgataaaacacttagtatgggcaagcagggagctggaaagatttgcgcttaaccctggccttttagagacgtcagacggatgtaaacaaataataaaacagctacatccagctcttaagacaggaacagaggaacttaggtcattattcaacacagtagcaactctctattgtgtacatgcagggatagaggtacgagacaccaaggaagccttagacaagatagaggaagaacaaaacaaaagtcagcaaaaaatacagcaggcaaaagaggctgacggaaaggtcagtcaaaattatcctatagtgcaaaatctccaagggcaaatggtacaccagcccctatcacctagaactttgaatgcgtgggtaaaagtaatagaggagaaggcttttagcccagaggtaatacccatgttcacagcattatcagaaggagccaccccctctgatttaaacaccatgttaaatacagtggggggacatcaagcagccatgcaaatgttaaaagataccatcaacgaggaggctgcggaatgggatagattacatccagtacatgcagggcctaatccaccaggccagatgagagaaccaaggggaagtgatatagcaggaactactagtacccttcaggaacaaatagcatggatgacaggtaacccacctattccagtgggagacatctataaaagatggataattctggggttaaataaaatagtaagaatgtatagccctgtcagcattttggacataagacaagggccaaaggaaccctttagagactatgtagaccggttctttaaaactttaagagctgaacaagctacacaagaagtaaaaggttggatgacagacaccttgttggtccaaaatgcaaacccagattgtaagaccattttaagagcattaggaccaggggcttcattagaagaaatggtgacagcatgtcaaggagtgggaggacctagccacaaagcaagagtgttggctgaggcaatgagccaatcacatagtaacataatgatgcagagaggcaattttaaaggccctaaaagaattgttaaatgcttcaactgtggcaaggaagggcacatagccagaaattgcagggcccctagaaaaagaggctgttggaaatgtgggcaagaaggacaccaaatgaaagactgtactgagaggcaggctaattttttagggaaaatttggccttcccacaaggggaggccagggaatttccttcaaaacaggccagagccaacagccccaccagcagagagcttcaggttcaaggagacaacccccgctccgaagcaggagtcgaaagacagggaacccttaacttccctcaaatcactctttggcagcgaccccttgtctcaataaaagtagggggccagataaaggaagctctcttagacacaggagcagatgatacagtattagaagaaatagctttgccaggaagatggaaaccaaaaatgataggaggaattggaggttttatcaaagtaagacagtatgatcaaatacttatagaaatttgtggaaaaaaggctataggtacagtattagtaggacctacacctgtcaacataattggaagagatatgttgactcagcttggatgcactctaaattttccaattagccccattgaaactgtaccagtaaaattaaagccaggaatggatggcccaaaggttaaacagtggccattgacagaagagaaaataaaagcattaacagaaatttgtaaagaaatggagaaggaaggaaaaattacaaaaattgggcctgaaaatccatataacactccagtatttgccataaaaaggaaggacagtactaagtggagaaaattagtagatttcagggagctcaataaaagaactcaagacttttgggaagttcaattaggaataccacacccagcaggtttaaaaaagaaaaaatcagtgacagtactggatgtgggggatgcatatttttcagttcctttagatgaaggcttcgggaaatatactgcattcaccatacctagtataaacaatgaaacaccagggattagatatcaatataatgtgcttccacagggatggaaaggatcaccagcaatattccagagtagcatgacaaaaatcttagagccctttagggcacgaaatccaaaaatagtcatctatcaatatatggatgacttgtatgtagggtctgacttagaaatagggcatcatagagcaaaaatagaggagttaagagcacatctattaaagtggggattcaccacaccagataagaaacatcagaaagaacccccatttctttggatggggtatgaactccatcctgacaaatggacagtacagcctataaagctgccagaaaaggatagctggactgtcaatgatatacagaagttagtgggaaaattaaactgggcaagtcagatttacccagggattaaagtgaggcaactttgtaaactccttaggggggccaaagcactaacagacatagtaccactaactgaagaagcagaattagaattagcagagaacagggaaattctaaaagagccagtacatggagtatattatgacccatcaaaagacttaatagctgaaatacagaaacaggggcatgaccaatggacatatcaaatttaccaagaaccattcaaaaatctgaaaacagggaagtatgcaaaaatgaggactgctcacactaatgatgtaaaacagttaacagaggcagtgcaaaaaatagccatagaaagcatagtaatatgggaaagacccctaaatttagactacccatccaaaaagaaacgtgggagacatggtggacagactattggcaggccacctggattcctgattgggagtttgttaatacccctcccctagtaaaattatggtaccagctagaaaaagaacccatagtaggagcagaaactttctatgtagatggagcagctaatagggaaactaaagtaggaaaagcagggtatgttactgacagaggaaggcagaaaattgtttctttaactgaaacaacaaatcagaagactgaattgcaagcaattcagctagctttgcaagattcaggaacagaagtaaacatagtaacagactcacagtatgcattaggaatcattcaagcacaaccagataaaagtgaatcagagttagtcaaccaaataatagaacaattaataaacaaagaaagagtctatctgtcatgggtaccagcacataaaggaattggagggaatgaacaagtagatagattagtaagtagtggaattaggaaagtactgtttctagatgggatagataaggctcaagaagatcatgaaaagtatcacagcaattggagagcaatggctaatgagtttaatctgccacccatagtagcaaaagaaatagtagctagctgtgataaatgccagctaaaaggggaagccatgcatggacaagtagaccgtagcccagggatatggcaattagattgtacacatctagaaggaaaaatcatcctggtagcagtccatgtagccagtggctacatagaagcagaggttatcccagcagaaacaggacaagaaacagcatactatatactaaaattagcaggaagatggccagtcaaagtaatacatacagacaatggtagtaatttcaccagtgctgcagttaaggcagcctgttggtgggcaggtatccaacaggaatttggaattccctacaatccccaaagccagggagtagtagaatccatgaataaagaattaaagaaaattatagggcaggtaagagaacaagctgagcaccttaagacagcagtacaaatggcagtattcattcacaattttaaaagaaaaggggggattggggggtacagtgcaggggaaagaacaatagacataatagcaacagacatacaaactaaagaattacaaaaccaaattacaaaaattcaaaattttcgggtttattacagagacagcagagaccccatttggaaaggaccagccaaactgctctggaaaggtgaaggggcagtagtaatacaagataatagtgacataaaggtagtgccaaggaggaaagcaaaaattattagggattatggaaaacagatggcaggtgctgattgtgtggcaggtagacaggatgaggatcagaacatggaatagtttagtaaaacaccatatgtatgtttcaagaagagctagtggatggttttacagacatcattatgaaagcagacatccaaaagtaagtgcagaagtacacatcccattaggagatgctagattagtaataaaaacatattggggtttacaaacaggagaaagagattggcatttgggtcatggcgtctccatagaatggagattgggaagatatagcacacaagtagaacctggcctggcagaccagctaatccatatgcattattttgattgttttgcagactctgccataagaaaagccatattaggacacatagttatttctaggtgtgattatcaagcaggacataataaggtaggatctctacaatacttggcactgacagcattgataaaaccaaaaaagagaaagccacctctgcctagtgttaagaaattagtagaggatagatggaacaatccccagaagaccagggaccacagagggaaccatacaatgaatggacactagagcttctagaggaactcaagcaggaagctgtcagacactttcctagaccttagcttcatagcttaggacaatatatctatgaaacatatggggatgcttggacaggagtcgaagctttaataagaacactgcaacaattactgtttattcatttcagaattgggtgccagcatagcagaataggcattttacaacggagaagagcaagaaatggagccagtagatcctaacctagagccctggaaccatccaggaagtcagcctaaaactgcttgtaatacatgctattgtaaacactgtagctaccattgtctagtttgctttcagacaaaaggcttaggcatttcctatggcaggaagaagcggagacagcgacgcagcgctcctccaagcagtgaggatcatcaaaatcttatatcaaagcagtaagtatatgtaatggtgaatttattagaaagagtagattatagattaggagtaggagcattaatagtagcattaatcttagcaataattgtgtggaccatagcatatctagaatataggaaattgttaagacaaagaaaaataaacaggttaattgaaagaattagggaaagagtagaagacagtggcaatgagagtgagggggatactgaggaattgtcaacactggtggatatggggaatcttaggcttttggatgctaatgatttataatgtagtagggaacttgtgggtcacagtctattatggggtacctgtgtggaaagaagcaaaaactactttattctgtgcatcagatgctaaagcttatgagaaggaggtgcataatatctgggctacacatgcctgtgtacccacagaccccaacccacaagagatggatttagtaaatgtaacagaaaattttaacatgtggaaaaatgacatggtggatcagatgcatgaggatgtaatcagtttatgggatcaaagcctaaagccatgtgtaaagttgaccccactctgtgtcactttaaactgtagtaaggttaccaataatgctacttacaataatactgatgatataaaaaattgctcttttaatgcaaccacagaaataagagacaagaaacgcaaagagtatgcactgttttatagactcgatatagtaccactaaatgagaataagaacagctctagtaactatagtgagtacatattaataaattgtaatacctcaaccataacacaagcctgtccaaaggtctcttttgacccaattcctatacattattgtgctccagctggttttgcgattctaaagtgtaaagatgagacattcaatgggacaggaccatgcaaggaggtcagtacagtacaatgtacacatggaattaagccagtggtatcaactcaactactgttaaatggtagcacagcagaaaaagagataataactagatctgaaaatataacagacaatgcaaaaactataatagtacatcttaatgaatccataaaaattgtatgtacaagacccaacaataacacaagaaaaagtataaggatagggccaggacaagcattctatgcaacaaacggcataataggagacataagacaagcacattgtaacattagtgaatctaactggactaaaactttacaagaggtaggaaaaaaattagcaaagcacttccctaataaaacaataagtttcaaccaatcctcaggaggggacctagaaattgtaacacatagctttaattgtggaggagaattcttttattgtaatacatcaagactgtttaacggtacatacaatggtacagacatgcctacatacaatggtacaaattccagttcagacatcatcatgcttccatgcagaataaggcaatttataaacatttggcagaaggtaggacgagcaatgtatgcccctcccattgaaggaaacataacatgtgaatcaaatatcacaggactactattagtacgtgatggaggcgacacaaatagtagcacagagatattcagacctggaggaggagatatgagggacaattggagaagtgaattatataaatataaagtggtagaaattaagccattaggaatagcacctactgaagcaaaaaggagagtggtggagagagaaaaaagagcagtgggaataggagctgtgttccttgggttcttgggagtagcaggaagcactatgggcgcggcgtcaatgacgctgacggtacaggccagacaattgttgtctggtatagtgcaacagcaaagcaatttgctgaaggctatagaggcgcaacagcatatgttgcaactcacagtctggggcattaagcagctccagacaagagtcttggctatagagagatacctaaaggatcaacagctcctagggatttggggctgctctggaaaagtcatctgccccactgctgtgccttggaactccagctggagtaataaatcaaaagatgatatttggaataacatgacctggatgcagtgggataaagagattagtaattacacaaacacaatataccggttgcttgaagaatcgcaaatccagcaggaacaaaatggaaaagatttattagcattggacagttggcaaaatctgtggaattggtttagcataacaaaatggctgtggtatataaaaatattcataattatagtaggaggcttgataggtttgagaataatttttgctgtgctatctatagtaaatagagttaggcagggatactcacctttgtcgttgcagacccttaccccagacccgagggaacccgacaggctcagaggaatcgaagaagaaggtggagagcaagacaaagacagatccattcgattagtgaacggattcttagcacttgcctgggacgatctacggagcctgtgcctcttcagttgccaccgattgagagacttcatattggttgcagcgagagcggtggaacttctgggacgcagcagtctcaggggactacagagggggtgggaagcccttaaatatctgggaagtcttgtgcagtattggggtctggaactaaaaaagagtgctattagtctgcttgataccatagcaataacaatagctgagggaacagataggattatagaatttacacaaagaatttgcagagctatccgcaacatacctagaagaataagacagggttttgaagcagctttgctataaaatggggagcaagatgtcaaaaagcagaatagttggatggcctgaggtaagagaaagaatgaggagaactgagccagcagcagagggagtaggagcagcatctcaagacttagctaaacatggagcacttacaaccagcaacacaccaagcaataatgctgctggtgcctggctgcaagcgcaagaggaggaagaagaagtaggctttccagtcagacctcaggtgcctttaagaccaatgacttataaaggagcattcgatctcgccttctttttaaaagaaaaggggggactggatgggttaatttactctaagaaaaggcatgaaatccttgatttatgggtttataacacacaaggctacttccctgattggcaaaactacacaccaggaccaggggtcagatatccactgacctttggatggtgctacaagctagtaccagttgacccaagtgtagtagaagaggccaacaaaggagaaaacaactgtttgctacaccctatgagccaacatggaatggatgatgaagatggagaagtattaaagtggcagtttgacagcagcctagcacgcagacacatagcccgcgagctacatccggagtattacaaagactgctgacacagaagggactttccactggggcgttccaggggagtggtctgggcgggacatgggagtggtcaaccctcagatgctgcatataagcagctgcttttcgcctgtactgggtctctctaggtggaccagatctgagcccgggagctctctggctacctagtgaacccactgcttaagcctcaataaagcttgccttgagtgctct

SEQ ID NO: 12 - DNA, 1479 bp, Human immunodeficiency virus type 1
  isolate=93BR020; gene=gag
atgggtgcgagagcgtcagtattaagcgggggaaaattagatgcttgggaaaaaattcggttaaggccggggggaaagaaaaaatatagactaaaacatctagtatgggcaagcagggagctagaacgatttgcacttgatccaggccttctagaaacatcagaaggctgtcgaaaaataataggacagttacaaccatcccttcagacaggatcagaagagctcaaatcattatataatacaatagcagtcctctattatgtacatcaaaaggtagaggtaaaagacaccaaggaggctttagagaagctagaggaagaacaaaacaaaggtcggcaaaagacacagcaagcgactgctgaaaaaggggtcagtcaaaattaccctatagtacagaatcttcagggacaaatggtacaccagtctttatcacctagaactttaaatgcatgggtaaaggtgatagaagagaaggcttttagtccagaagtaatacccatgttttcagcattatcagaaggggccactccacaagatttaaacaccatgttaaatacagtggggggacatcaagcagccatgcaaatgttaaaagacaccatcaatgaggaggctgcagaatgggacagattacatccaacacaggcaggacccatccccccaggtcagataagggaacctaggggaagtgatatagctggaactactagtacccttcaggaacaaatacaatggatgacaggcaacccacctgtcccagtgggagaaatgtataaaagatggatcatcctaggattaaataaaatagtaagaatgtatagccctgtcggcattttggacataagacaagggccaaaagaaccctttagagactatgtagacaggttctttaaaaccctaagagctgagcaagctacacaggaagtaaagggttggatgacagacaccttgttggtccaaaatgcgaacccagattgtaagaccattttaaaagcattgggaccaggggctacactagaggaaatgatgacagcatgtcagggagtgggaggacctagccataaggcaagagttttggctgaggcaatgagccaagcaacaaatacagctataatgatgcagaaaagtaactttaagggccaaagaagaattgttaaatgctttaattgtggcaaagaaggacacatagccaaaaattgcagggcccctagaaaaaagggctgttggaagtgtggaagagagggacaccaaatgaaggactgcactgagagacaggctaattttttagggaaaatttggccttccaacaaggggaggcccggaaacttcatccagaacaggccagagccgtcagccccgccagcagagagcttcaggttcggggaggagacaaccccatctccgaagcaggagcagaaagacgagggactgtaccctcccttagcttccctcaaatcactctttggcaacgacccctag

SEQ ID NO: 13 - DNA, 579 bp, Human immunodeficiency virus type 1
  isolate=93BR020; gene=vif
atggaaaacagatggcaggtgatgattgtgtggcaggtagacaggatgaggattaacacatggaaaagtttagtaaaataccatatgcatatttcaaagaaagccaaaggatggttttatagacatcactttgaaagcaggcatccaaaaataagttcagaagtacacatcccactagagacagctgaattagtaataacaacatactgggggctgcttccaggagaaagagaatggcatctgggtcagggagtctccatagaatggaggcaggggaggtatagaacacaaatagaccctggcctggcagaccaactgatccatatatattattttgattgtttttcagaatctgccataaggaaagccatattaggacataaaattagccctaggtgtaactatcaagcaggacataacaaggtaggatctctacaatacttggcactaacagcattaatagctccaaaaaagacaaagccgcctttgcctagtgtccagaaactagtagaagacagatggaacaagccccagaagaccaggggccacagagagagccatacaatgaatggacactag

SEQ ID NO: 14 - DNA, 291 bp, Human immunodeficiency virus type 1
  isolate=93BR020; gene=vpr
atggaacaagccccagaagaccaggggccacagagagagccatacaatgaatggacactagatcttttagaggagcttaagaatgaagctgttagacattttcctaggccatggctccatagcttaggacaacatatctataacacctatggggatacttgggaaggagttgaagcaatcataaggatattgcaacaactactgtttatccatttcagaattgggtgccgtcatagcagaataggcattactcgacagagaagagtaagaaatggaactagtagatcctaa

SEQ ID NO: 15 - DNA, 2610 bp, Human immunodeficiency virus type 1
  isolate=93BR020; gene=tat
atggaactagtagatcctaacttagatccctggaaccatccaggaagccagcctacaactccttgtaccagatgttattgtaaatggtgttgctttcattgttactggtgctttacaacgaagggcttaggcatctcctatggcaggaagaagcggagacagcgaccaagaactcctcaaagcagtcagatacatcaagattttgtaccaaagcagtaagtattgttaagcatatgtaatgtcaaatttgttagcaataggcatagcagcattaatagtagcactaataataacaatagttgtgtggactatagcatatatagaatataagaaactggtaaggcaaagaaaaataaataggttatataaaagaataagcgaaagagcagaagacagtggcaatgagagtgagggggatgcagaggaattggcagcacttggggaagtggggccttttattcctggggacattaataatctgtaatgctgcagaaaacttatgggttacagtctattatggggtacctgtgtggaaagaagcaaccactactctattctgtgcatcagatgctaaatcatatgaaaaagaggcacataatgtctgggctacacatgcttgtgtacccacagatcccaatccacaagaagtagttctggaaaatgtaacagaaaggtttaatatgtgggaaaataacatggtagaacaaatgcatacagatataatcagtttatgggatcaaagcctaaagccatgtgtgaagttaaccccactctgtgttactttagattgtagaaacattgccaccaatggcaccaatgacactattgccatcaatgacactctgaaggaagatccagaggcaatacaaaactgttctttcaatacaaccacagaaataagagataagcagctgaaagtacatgcacttttttataaacttgatatagtacaaatcaacaaggatgacaatagaacatacagactaataaattgtgatgcctcaaccattacacaggcttgtccaaaggtatcttgggatccaattcccatacattattgtgctccagctggttatgcgattctaaagtgtaatgagaaaaatttcacagggacagggtcatgcaagaatgtcagtacagtacaatgtacacatggaattaaaccagtggtatccactcaattgttgttaaatggcagcctagcagaaggagagatagtaatcagatctcaaaatatctcagataatgcaaaaaccataatagtgcaccttaatgaatctgtacagattaattgtacaagacccaacaacaatacaagaaaaagaatatctttaggaccaggacgagtattttatacaacaggagaaataataggagacatcagaaaggcacattgtaacgttagtggaacacaatggaggaacacgttagcaaaggtaaaggcaaagttagggtcttatttccctaatgcaacaataaaatttaactcatcctcaggaggggacctagaaattacaaggcataattttaattgtatgggagaatttttctactgtaatacagatgaactgtttaatgacacaaaattcaatgacacaggattcaatggcactatcactctcccatgtcgaataaaacaaattgtaaacatgtggcaggaagtgggacgagcaatgtatgccaatcccattgcaggaaacattacctgtaactcaaatattacaggtctgctattgacaagagatggtggtctgaatagtactaatgagaccttcagacctgggggaggaaatatgaaagacaattggagaagtgaattatataaatataaagtagtagaaattgaaccactaggagtagcacccaccaaggcaaaaagacaagtggtgaagagagaaagaagagcagtgggactaggagctctgttccttgggttcttgggagcagctggaagcactatgggcgcggcgtcaataacgctgacggtacaggccagacaattattgtctggaatagtgcaacagcagagcaatctgctgagggctattgaagcgcaacagcatctgttgcagctcacagtctggggcattaaacagctccaggcaagagtcctggctgtggaaagatacctaaaggatcaacagctcctagggctttggggctgctctggaaaactcatctgcaccactaatgtgccctggaactctagttggagtaataaatctcttgaggagatttgggggaacatgacctggatggagtgggaaaaagaggttagcaattactcaaaagaaatatacaggttaattgaagactcgcagaaccagcaggaaaagaatgaacaagaattattagcattggacaaatgggcaagtctgtggaattggtttgacataacacagtggctgtggtatataaaaatattcataatgatagtaggaggcttgataggcttaagaatagtttttactgtgctttctatagtaaatagagttaggaagggatactcacctttgtcatttcagacccatatcccaagcccgagggaacccgacaggcccgaaggaatcgaagaaggaggtggagagcaaggcaaagacagatccgtga

SEQ ID NO: 16 - DNA, 2661 bp, Human immunodeficiency virus type 1
  isolate=93BR020; gene=rev
atggcaggaagaagcggagacagcgaccaagaactcctcaaagcagtcagatacatcaagattttgtaccaaagcagtaagtattgttaagcatatgtaatgtcaaatttgttagcaataggcatagcagcattaatagtagcactaataataacaatagttgtgtggactatagcatatatagaatataagaaactggtaaggcaaagaaaaataaataggttatataaaagaataagcgaaagagcagaagacagtggcaatgagagtgagggggatgcagaggaattggcagcacttggggaagtggggccttttattcctggggacattaataatctgtaatgctgcagaaaacttatgggttacagtctattatggggtacctgtgtggaaagaagcaaccactactctattctgtgcatcagatgctaaatcatatgaaaaagaggcacataatgtctgggctacacatgcttgtgtacccacagatcccaatccacaagaagtagttctggaaaatgtaacagaaaggtttaatatgtgggaaaataacatggtagaacaaatgcatacagatataatcagtttatgggatcaaagcctaaagccatgtgtgaagttaaccccactctgtgttactttagattgtagaaacattgccaccaatggcaccaatgacactattgccatcaatgacactctgaaggaagatccagaggcaatacaaaactgttctttcaatacaaccacagaaataagagataagcagctgaaagtacatgcacttttttataaacttgatatagtacaaatcaacaaggatgacaatagaacatacagactaataaattgtgatgcctcaaccattacacaggcttgtccaaaggtatcttgggatccaattcccatacattattgtgctccagctggttatgcgattctaaagtgtaatgagaaaaatttcacagggacagggtcatgcaagaatgtcagtacagtacaatgtacacatggaattaaaccagtggtatccactcaattgttgttaaatggcagcctagcagaaggagagatagtaatcagatctcaaaatatctcagataatgcaaaaaccataatagtgcaccttaatgaatctgtacagattaattgtacaagacccaacaacaatacaagaaaaagaatatctttaggaccaggacgagtattttatacaacaggagaaataataggagacatcagaaaggcacattgtaacgttagtggaacacaatggaggaacacgttagcaaaggtaaaggcaaagttagggtcttatttccctaatgcaacaataaaatttaactcatcctcaggaggggacctagaaattacaaggcataattttaattgtatgggagaatttttctactgtaatacagatgaactgtttaatgacacaaaattcaatgacacaggattcaatggcactatcactctcccatgtcgaataaaacaaattgtaaacatgtggcaggaagtgggacgagcaatgtatgccaatcccattgcaggaaacattacctgtaactcaaatattacaggtctgctattgacaagagatggtggtctgaatagtactaatgagaccttcagacctgggggaggaaatatgaaagacaattggagaagtgaattatataaatataaagtagtagaaattgaaccactaggagtagcacccaccaaggcaaaaagacaagtggtgaagagagaaagaagagcagtgggactaggagctctgttccttgggttcttgggagcagctggaagcactatgggcgcggcgtcaataacgctgacggtacaggccagacaattattgtctggaatagtgcaacagcagagcaatctgctgagggctattgaagcgcaacagcatctgttgcagctcacagtctggggcattaaacagctccaggcaagagtcctggctgtggaaagatacctaaaggatcaacagctcctagggctttggggctgctctggaaaactcatctgcaccactaatgtgccctggaactctagttggagtaataaatctcttgaggagatttgggggaacatgacctggatggagtgggaaaaagaggttagcaattactcaaaagaaatatacaggttaattgaagactcgcagaaccagcaggaaaagaatgaacaagaattattagcattggacaaatgggcaagtctgtggaattggtttgacataacacagtggctgtggtatataaaaatattcataatgatagtaggaggcttgataggcttaagaatagtttttactgtgctttctatagtaaatagagttaggaagggatactcacctttgtcatttcagacccatatcccaagcccgagggaacccgacaggcccgaaggaatcgaagaaggaggtggagagcaaggcaaagacagatccgtgagattagtgaccggattcttagctcttgcctgggacgacctgcggaacctgtgcctcttcagctaccgccacttgagagacttcatattaattgcagcgaggattgtggacagggggctgaagagggggtgggaagctctcaaatatctggggaatctcacacagtattggggtcaggaactaaagaatag

SEQ ID NO: 17 - DNA, 246 bp, Human immunodeficiency virus type 1
  isolate=93BR020; gene=vpu
atgtcaaatttgttagcaataggcatagcagcattaatagtagcactaataataacaatagttgtgtggactatagcatatatagaatataagaaactggtaaggcaaagaaaaataaataggttatataaaagaataagcgaaagagcagaagacagtggcaatgagagtgagggggatgcagaggaattggcagcacttggggaagtggggccttttattcctggggacattaataatctgtaa

SEQ ID NO: 18 - DNA, 2541 bp, Human immunodeficiency virus type 1
  isolate=93BR020; gene=env
atgagagtgagggggatgcagaggaattggcagcacttggggaagtggggccttttattcctggggacattaataatctgtaatgctgcagaaaacttatgggttacagtctattatggggtacctgtgtggaaagaagcaaccactactctattctgtgcatcagatgctaaatcatatgaaaaagaggcacataatgtctgggctacacatgcttgtgtacccacagatcccaatccacaagaagtagttctggaaaatgtaacagaaaggtttaatatgtgggaaaataacatggtagaacaaatgcatacagatataatcagtttatgggatcaaagcctaaagccatgtgtgaagttaaccccactctgtgttactttagattgtagaaacattgccaccaatggcaccaatgacactattgccatcaatgacactctgaaggaagatccagaggcaatacaaaactgttctttcaatacaaccacagaaataagagataagcagctgaaagtacatgcacttttttataaacttgatatagtacaaatcaacaaggatgacaatagaacatacagactaataaattgtgatgcctcaaccattacacaggcttgtccaaaggtatcttgggatccaattcccatacattattgtgctccagctggttatgcgattctaaagtgtaatgagaaaaatttcacagggacagggtcatgcaagaatgtcagtacagtacaatgtacacatggaattaaaccagtggtatccactcaattgttgttaaatggcagcctagcagaaggagagatagtaatcagatctcaaaatatctcagataatgcaaaaaccataatagtgcaccttaatgaatctgtacagattaattgtacaagacccaacaacaatacaagaaaaagaatatctttaggaccaggacgagtattttatacaacaggagaaataataggagacatcagaaaggcacattgtaacgttagtggaacacaatggaggaacacgttagcaaaggtaaaggcaaagttagggtcttatttccctaatgcaacaataaaatttaactcatcctcaggaggggacctagaaattacaaggcataattttaattgtatgggagaatttttctactgtaatacagatgaactgtttaatgacacaaaattcaatgacacaggattcaatggcactatcactctcccatgtcgaataaaacaaattgtaaacatgtggcaggaagtgggacgagcaatgtatgccaatcccattgcaggaaacattacctgtaactcaaatattacaggtctgctattgacaagagatggtggtctgaatagtactaatgagaccttcagacctgggggaggaaatatgaaagacaattggagaagtgaattatataaatataaagtagtagaaattgaaccactaggagtagcacccaccaaggcaaaaagacaagtggtgaagagagaaagaagagcagtgggactaggagctctgttccttgggttcttgggagcagctggaagcactatgggcgcggcgtcaataacgctgacggtacaggccagacaattattgtctggaatagtgcaacagcagagcaatctgctgagggctattgaagcgcaacagcatctgttgcagctcacagtctggggcattaaacagctccaggcaagagtcctggctgtggaaagatacctaaaggatcaacagctcctagggctttggggctgctctggaaaactcatctgcaccactaatgtgccctggaactctagttggagtaataaatctcttgaggagatttgggggaacatgacctggatggagtgggaaaaagaggttagcaattactcaaaagaaatatacaggttaattgaagactcgcagaaccagcaggaaaagaatgaacaagaattattagcattggacaaatgggcaagtctgtggaattggtttgacataacacagtggctgtggtatataaaaatattcataatgatagtaggaggcttgataggcttaagaatagtttttactgtgctttctatagtaaatagagttaggaagggatactcacctttgtcatttcagacccatatcccaagcccgagggaacccgacaggcccgaaggaatcgaagaaggaggtggagagcaaggcaaagacagatccgtgagattagtgaccggattcttagctcttgcctgggacgacctgcggaacctgtgcctcttcagctaccgccacttgagagacttcatattaattgcagcgaggattgtggacagggggctgaagagggggtgggaagctctcaaatatctggggaatctcacacagtattggggtcaggaactaaagaatagtgctattagcttgcttaatgccacagcaatagcagtagctgagtggacagatagagttatagaagctttgcaaagagctggtagagctattctcaacatacctagaagaataagacagggcttggaaagggctttgctataa

SEQ ID NO: 19 - DNA, 27 bp, Human immunodeficiency virus type 1
  isolate=93BR020; gene=nef
atgggtggcaagtggtcaaaaagtagt

SEQ ID NO: 20 - DNA, 8 bp, Human immunodeficiency virus type 1
  isolate=93BR020; gene=gag-pol fusion
aaaaaaaa

SEQ ID NO: 21 - DNA, 207 bp, Human immunodeficiency virus type 1
  isolate=92NG083; gene=gag
gtgggtgcgagagcgtcagtattaagcgggggaaaattagattcttgggaaaaaattcggttaaggccagggggaaggaaaaagtataaactaaaacatatagtatgggcaagcagggaactggggagatttgcacttaaccgtgaccttttagaaacagcagaaggttgtgtgcaaataatgaaacagttgcaaccagctctctag

SEQ ID NO: 22 - DNA, 2739 bp, Human immunodeficiency virus type 1
  isolate=92NG083; gene=pol; note=NH2-terminus uncertain
ataaatttaccaggaaaatggaaaccaaaaatgatagggggaattggaggttttatcaaagtaagacagtatgatcaaatacttatagaaattggtggaaaaaaggctatagggacagtattagtaggacctacacctattaacataattgggagaaatatgttgactcagattggttgtactttaaactttccaataagtcctattgaaactgtaccagtaaaattaaagccaggaatggatggcccaagggttaaacaatggccattgacagaagagaaaataaaagcattaacagaaatttgtaaagacatggaaaaggaaggaaaaatttcaaaaattgggcctgaaaatccatataacactccaatattcgccataaagaaaaaagacagtactaaatggagaaaattggtagatttcagagaacttaataaaagaactcaagacttctgggaggtccaattaggaatacctcaccccgcggggttaaaaaagaaaagatcagtaacggtactagatgtgggagatgcatacttttcagttcccttagataaagactttagaaagtatactgcatttactatacctagtataaataatgagacaccagggattagatatcaatacaatgtgcttccacagggatggaaaggatcaccagcaatatttcagagtagcatgacaaaaattttagagccttctagaacaaaaaatccagaaatggtgatctaccaatacatggatgatttatatgtaggatctgacttagaaatagggcagcatagagcaaaaatagaggagttaagagaacatctactgaaatggggattgaccacaccagataaaaaacatcagaaagaacctccattcctttggatgggatatgagctccatcctgacaaatggacggtacaacctatacagctgccagaaaaggaagattggactgtcaatgatatacaaaagttagtgggaaaactaaattgggcaagtcagatttatccagggattaaagtaaagcacctatgtagactccttaggggggccaaagcactaacagacatagtacccctaacggcagaagcagaaatggagctggcagagaacagggaaattctaaaagaacctgtacatggagtctatcatgacccatcaaaagaattaatagcagaagtacagaagcaagggccagaccaatggacatatcaaatttatcaagagccatacaaaaatctaaaaacaggaaaatatgcaaaaagggggtctgcccacactaatgatgtaaaacaattaacagaagtagtgcaaaaaatagccacagagggcatagtaatctggggaaagattcctaaatttaaactacctatacgaaaagaaacatgggaagtatggtggacagagtactggcaggccgcctggattcctgagtgggagtttgtcaatacccctcctctagtaaaactatggtatcaattagaaacagaacccataccaggagcagaaacttactatgtagatggggcagctaatagggagacaaaattaggaaaggcaggacatgttactgacaaaggaaaacaaaaaattattaccctaactgaaacaacaaaccaaaaggctgaattacatgcaattcaactagctttgcaggactcaagaccagaagtaaacatagtaacagactcacagtatgcattaggaatcattcaagcacaaccagataggagtggatcagaattagtcaatcaaataatagaacagctaataaaaaaggaaaaggtctacctgtcatgggtaccagcacacaaagggattggaggaaatgaacaagtagataagctagtcagtagtggaatcaggaaagtattatttttggatggcatagataaagcccaagaagaacatgaaagatatcacagcaattggagagcaatggctagtgattttaatctgccacctgtagtagcaaaagaaatagtggccagctgtgataaatgtcaactaaaaggggaagccatgcatggacaagtagactgtagtccaggaatatggcaattagattgtacacatttagaaggaaaaattatcatagtagcagttcatgtagccagtggctatatagaagcagaagttatcccagcagaaacagggcaggaaacagcatactttatattaaaattagcaggaaggtggccagtaaaagtgatacatacagacaatggtcccaatttcatcagtgctgcagtaaaggcagcatgttggtgggcaaatatcacacaggaatttggaattccctacaatccccaaagccaaggagtagtggaatctatgaataaggaattaaagaaaatcatcggacaggttggagatcaagctgaacatcttaagacagcagtacagatggcagtattcattcacaattttaaaagaaaaggggggattggggggtacagtgcaggggaaagaataatagacataatagcatcagatatacaaactaaagaactacaaaaacaaattataaaaattcaaaattttcgggtttattacagggacagcagagacccaatttggaaaggaccagcaaagctactctggaaaggtgaaggggcagtagtaatacaggacaataacgaaataaaggtagtaccaagaagaaaagcaaagatccttaaggattatggaaaacagatggcaggtggtgattgtgtggcaggtagacaggatgaggattag

SEQ ID NO: 23 - DNA, 579 bp, Human immunodeficiency virus type 1
  isolate=92NG083; gene=vif
atggaaaacagatggcaggtggtgattgtgtggcaggtagacaggatgaggattagaacatggaacagtttagtaaaacatcatatgtatgtctcaaagaaagctaaaggctggttttatagacatcactatgaaagcaggcatccaagagtaagttcagaagtacacatcccactaagagatgctacactagtagtaagaacatattggggtctgcatgcaggagaaaaagactggcaattgggccatggggtttccatagaatggaggcagaaaagatatagtacacaaatagaccctaacacagcagaccatctgattcatctgtattattttgactgtttttcagaatctgccataagaaaagccatattaggagagatagttagccctaggtgtgaatacccagcaggacataataaggtaggatctctacaatatctggcatcgaaagcattagtaacaccaacaaggaaaaggccacctttgccaagtgttgggaaattagcagaagatagatggaacaagccccagaagaccagggaccacagagagaaccctacaatgaatggacattag

SEQ ID NO: 24 - DNA, 291 bp, Human immunodeficiency virus type 1
  isolate=92NG083; gene=vpr
atggaacaagccccagaagaccagggaccacagagagaaccctacaatgaatggacattagaactgttagaagagcttaaaaatgaagctgttagacattttcctaggccctggctccatggcttaggacagtatatctataacacttatggggatacttgggaaggagttgaagccataataagaatactacaacaactactgtttatccatttcagaatcgggtgccaacatagcagaataggcattactccacagagaagagtaagggatggacccggtagaccctaa

SEQ ID NO: 25 - DNA, 2597 bp, Human immunodeficiency virus type 1
  isolate=92NG083; gene=tat
atggacccggtagaccctaagctagagccctggaatcatccggggagtcagcctacaactccctgtaacaaatgttattgtaaagtgtgctgctggcattgtcaagtttgctttttaaacaaaggcttaggcatctcctatggcaggaagaagcggagaccccgacgaggaactcctcagggcagtaaggatcatcaaaaccctgtaccaaagcagtaagtagtaacaattaatatatgtaatgcaggccttagaaatatctgactaatagtagcattcatagcagccacaattgtgtggagtatagtatttatagaatatagaaaaataagaaaacagaaaaaaatagaaaagttacttgatagaataagagaaagagcagaagacagtggaaatgagagtgaaggggatacagaggaattggcaacacttatggaaatgggggactttgatccttgggttggtaataatttgtagtgcctcagataacttgtgggtcacagtctattatggggtacctgtgtgggaagatgcagatacccccctattctgtgcctctgatgctaaatcatatagttctgaaaaacataatgtctgggctacacatgcctgtgtacccacagaccctaacccacaagaaatagctatagaaaatgtaacagaaaattttaacatgtggaagaataacatggtagaacagatgcaggaggatataatcagtttatgggaggaaagcctaaagccatgtgtaaagctaactcctctctgtatcactttaaactgtactaatgtaaacagtgctaatcatactgaggccaataacactgtagaaaacaaagaagaaataaaaaactgctctttcaagataaccacagaaaggggaggcaagaagaaggaagaatacgcgcttttctataaacttgatgtggtaccaattagtaatgggaataagactagttataggctaatacattgtaatgtctcaaccattaaacaggcttgtccaaaggtaaattttgacccaattcccatacattattgtgctccagctggttttgcgattttaaagtgtagggataaggagtacaatggaacaggaccatgtaaaaatgtcagtacagtacaatgtacacatggaattaagccagtggtatcaactcaactactgctgaatggcagtttagcagaagaagatataagaattagatctgaaaatttcacagacaataccaaagtcataatagtgcagcttaataatagtatagaaattaattgtatcagacccaataacaatacaagaaaaagtataccaatcggaccaggacaagcgttctatgcaacaggtgatataataggagacataagacaagcacattgtaatgttagtagaataaaatggagggagatgttaaagaatgtcacagcacagctaaggaaaatctataataataagaacataacctttaactcatctgcaggaggggacctagaaattacaacacatagtttcaattgtagaggagagtttttctattgcaatacatcaggactgtttaataataatattagtaatattaataatgagactatcacactcccatgtaaaataaaacaaattgtgaggatgtggcagaaagtgggacaagcaatgtatgcccttcccatcgcaggaaaccttgtatgtaaatcaaacattacaggattaatattaacaagagatggtgggaataacaatgacagtacagaggagaccttcagacctggaggaggagatatgagggacaattggagaagtgaattatataagtataaaacagtaaaaatcaaatcactaggagtagcacccaccagggcaaggagaagagtggtggagagagaaaaaagagcagttggactgggagctgtcttccttgggttcttaggagcagcagggagcactatgggcgcggcgtcaataacgctgacggcacaggtcagacaattattgtctggcatagtgcaacagcaaagcaatttgctgagggctatagaggcgcagcagcatctgttgcaactcacagtctggggcattaaacagctccagtcaagagtcctggctatagaaagatacctaaaggatcaacagctcctagggatttggggctgctctggaaaactcatctgcaccactaatgtgccctggaacactagttggagtaataaatcttataatgagatttgggataacatgacttggctagaatgggaaagggaaattcacaattacacacaacacatatacagcctgattgaagaatcgcagaaccagcaggaaaagaatgaacaagacttattggcattggacaagtgggcaagtttgtggaattggtttgacatatcaaattggctatggtatataagaatattcataatgatagtaggaggtttaataggtttaagaatagtttttgctgtgctttctatagtaaatagagttaggcagggatactcacctttgtcgttccagacccttacccatcaccagcgggaacccgacaggctcggaaaaaccgaagaaggaggtggcgagcaagacagagacagatccactcgattag

SEQ ID NO: 26 - DNA, 2663 bp, Human immunodeficiency virus type 1
  isolate=92NG083; gene=rev
atggcaggaagaagcggagaccccgacgaggaactcctcagggcagtaaggatcatcaaaaccctgtaccaaagcagtaagtagtaacaattaatatatgtaatgcaggccttagaaatatctgactaatagtagcattcatagcagccacaattgtgtggagtatagtatttatagaatatagaaaaataagaaaacagaaaaaaatagaaaagttacttgatagaataagagaaagagcagaagacagtggaaatgagagtgaaggggatacagaggaattggcaacacttatggaaatgggggactttgatccttgggttggtaataatttgtagtgcctcagataacttgtgggtcacagtctattatggggtacctgtgtgggaagatgcagatacccccctattctgtgcctctgatgctaaatcatatagttctgaaaaacataatgtctgggctacacatgcctgtgtacccacagaccctaacccacaagaaatagctatagaaaatgtaacagaaaattttaacatgtggaagaataacatggtagaacagatgcaggaggatataatcagtttatgggaggaaagcctaaagccatgtgtaaagctaactcctctctgtatcactttaaactgtactaatgtaaacagtgctaatcatactgaggccaataacactgtagaaaacaaagaagaaataaaaaactgctctttcaagataaccacagaaaggggaggcaagaagaaggaagaatacgcgcttttctataaacttgatgtggtaccaattagtaatgggaataagactagttataggctaatacattgtaatgtctcaaccattaaacaggcttgtccaaaggtaaattttgacccaattcccatacattattgtgctccagctggttttgcgattttaaagtgtagggataaggagtacaatggaacaggaccatgtaaaaatgtcagtacagtacaatgtacacatggaattaagccagtggtatcaactcaactactgctgaatggcagtttagcagaagaagatataagaattagatctgaaaatttcacagacaataccaaagtcataatagtgcagcttaataatagtatagaaattaattgtatcagacccaataacaatacaagaaaaagtataccaatcggaccaggacaagcgttctatgcaacaggtgatataataggagacataagacaagcacattgtaatgttagtagaataaaatggagggagatgttaaagaatgtcacagcacagctaaggaaaatctataataataagaacataacctttaactcatctgcaggaggggacctagaaattacaacacatagtttcaattgtagaggagagtttttctattgcaatacatcaggactgtttaataataatattagtaatattaataatgagactatcacactcccatgtaaaataaaacaaattgtgaggatgtggcagaaagtgggacaagcaatgtatgcccttcccatcgcaggaaaccttgtatgtaaatcaaacattacaggattaatattaacaagagatggtgggaataacaatgacagtacagaggagaccttcagacctggaggaggagatatgagggacaattggagaagtgaattatataagtataaaacagtaaaaatcaaatcactaggagtagcacccaccagggcaaggagaagagtggtggagagagaaaaaagagcagttggactgggagctgtcttccttgggttcttaggagcagcagggagcactatgggcgcggcgtcaataacgctgacggcacaggtcagacaattattgtctggcatagtgcaacagcaaagcaatttgctgagggctatagaggcgcagcagcatctgttgcaactcacagtctggggcattaaacagctccagtcaagagtcctggctatagaaagatacctaaaggatcaacagctcctagggatttggggctgctctggaaaactcatctgcaccactaatgtgccctggaacactagttggagtaataaatcttataatgagatttgggataacatgacttggctagaatgggaaagggaaattcacaattacacacaacacatatacagcctgattgaagaatcgcagaaccagcaggaaaagaatgaacaagacttattggcattggacaagtgggcaagtttgtggaattggtttgacatatcaaattggctatggtatataagaatattcataatgatagtaggaggtttaataggtttaagaatagtttttgctgtgctttctatagtaaatagagttaggcagggatactcacctttgtcgttccagacccttacccatcaccagcgggaacccgacaggctcggaaaaaccgaagaaggaggtggcgagcaagacagagacagatccactcgattagtgagcggattcttagcgcttgcctgggacgacctgcggagcctgtgccttttcagctaccaccgcttgagggacttagtcttgattgcagcaaggacggtggaacttctgggacgcagcagcctcaagggactgagactggggtgggaaggcctcaagtacttgtggaacctcctgttgtattggggtcgggaactaaagaatag

SEQ ID NO: 27 - DNA, 26 bp, Human immunodeficiency virus type 1
  isolate=92NG083; gene=vpu (defective); note=10 bp deletion early in vpu frameshifts, results in premature termination
tgcaggccttagaaatatctgactaa

SEQ ID NO: 28 - DNA, 2550 bp, Human immunodeficiency virus type 1
  isolate=92NG083; gene=env
atgagagtgaaggggatacagaggaattggcaacacttatggaaatgggggactttgatccttgggttggtaataatttgtagtgcctcagataacttgtgggtcacagtctattatggggtacctgtgtgggaagatgcagatacccccctattctgtgcctctgatgctaaatcatatagttctgaaaaacataatgtctgggctacacatgcctgtgtacccacagaccctaacccacaagaaatagctatagaaaatgtaacagaaaattttaacatgtggaagaataacatggtagaacagatgcaggaggatataatcagtttatgggaggaaagcctaaagccatgtgtaaagctaactcctctctgtatcactttaaactgtactaatgtaaacagtgctaatcatactgaggccaataacactgtagaaaacaaagaagaaataaaaaactgctctttcaagataaccacagaaaggggaggcaagaagaaggaagaatacgcgcttttctataaacttgatgtggtaccaattagtaatgggaataagactagttataggctaatacattgtaatgtctcaaccattaaacaggcttgtccaaaggtaaattttgacccaattcccatacattattgtgctccagctggttttgcgattttaaagtgtagggataaggagtacaatggaacaggaccatgtaaaaatgtcagtacagtacaatgtacacatggaattaagccagtggtatcaactcaactactgctgaatggcagtttagcagaagaagatataagaattagatctgaaaatttcacagacaataccaaagtcataatagtgcagcttaataatagtatagaaattaattgtatcagacccaataacaatacaagaaaaagtataccaatcggaccaggacaagcgttctatgcaacaggtgatataataggagacataagacaagcacattgtaatgttagtagaataaaatggagggagatgttaaagaatgtcacagcacagctaaggaaaatctataataataagaacataacctttaactcatctgcaggaggggacctagaaattacaacacatagtttcaattgtagaggagagtttttctattgcaatacatcaggactgtttaataataatattagtaatattaataatgagactatcacactcccatgtaaaataaaacaaattgtgaggatgtggcagaaagtgggacaagcaatgtatgcccttcccatcgcaggaaaccttgtatgtaaatcaaacattacaggattaatattaacaagagatggtgggaataacaatgacagtacagaggagaccttcagacctggaggaggagatatgagggacaattggagaagtgaattatataagtataaaacagtaaaaatcaaatcactaggagtagcacccaccagggcaaggagaagagtggtggagagagaaaaaagagcagttggactgggagctgtcttccttgggttcttaggagcagcagggagcactatgggcgcggcgtcaataacgctgacggcacaggtcagacaattattgtctggcatagtgcaacagcaaagcaatttgctgagggctatagaggcgcagcagcatctgttgcaactcacagtctggggcattaaacagctccagtcaagagtcctggctatagaaagatacctaaaggatcaacagctcctagggatttggggctgctctggaaaactcatctgcaccactaatgtgccctggaacactagttggagtaataaatcttataatgagatttgggataacatgacttggctagaatgggaaagggaaattcacaattacacacaacacatatacagcctgattgaagaatcgcagaaccagcaggaaaagaatgaacaagacttattggcattggacaagtgggcaagtttgtggaattggtttgacatatcaaattggctatggtatataagaatattcataatgatagtaggaggtttaataggtttaagaatagtttttgctgtgctttctatagtaaatagagttaggcagggatactcacctttgtcgttccagacccttacccatcaccagcgggaacccgacaggctcggaaaaaccgaagaaggaggtggcgagcaagacagagacagatccactcgattagtgagcggattcttagcgcttgcctgggacgacctgcggagcctgtgccttttcagctaccaccgcttgagggacttagtcttgattgcagcaaggacggtggaacttctgggacgcagcagcctcaagggactgagactggggtgggaaggcctcaagtacttgtggaacctcctgttgtattggggtcgggaactaaagaatagtgctattaatttgcttgatacaatagcaatagcaacagctaacgggacagatagggttatagaagtagcacaaagagcttatagagctattctcaacgtacctacaaggataagacaaggcttagaaagagctttgctataa

SEQ ID NO: 29 - DNA, 1503 bp, Human immunodeficiency virus type 1
  isolate=90CR056; gene=gag; CDS: join(137..1434,1434..4443)
atgggtgcgagagcgtcagtattaagcggcggaaaattagatgcttgggagaaaattcggctaaggccagggggaaagaaaaaatataggctaaaacatctagtatgggcaagcagggagctggaaagatttgcacttaaccccggccttttagaaacaccagaaggctgtctacagataatagaacagatacagccagctattaagacaggaacagaagaacttaaatcattatttaatctagtagcagtcctctattgcgtacatcgaaaaatagatgtgaaagacaccaaggaggctttagataagatagaggaaatacaaaacaaaagtcagcaaaaaacacagcaagcagcagctgataaggaaaaagacaacaaggtcagtcaaaattatcctatagtacagaatgctcaagggcagatggtacaccaggccatatcacctaggaccttaaatgcatgggtaaaagtagtagaagaaaaggcttttagcccagaagtaatacccatgttttcagcattatcagaaggagccaccccacaagacttaaatgctatgctaaatacagtggggggacatcaagcagccatgcagatgttaaaagatacaatcaatgaggaagctgcagaatgggacagggtacatccagtgcatgcagggcctattccaccaggccaaatgagagaaccaaggggaagcgatatagcaggaactactagtaccctgcaggaacaaatagcatggatgacaggcaatccagctatcccagtgggagacatctataaaagatggataatcctgggattaaataagatagtaagaatgtatagtcctgtcagcattctggacataaaacaagggccaaaagaaccctttagagactatgtagacaggttttttaaaactttaagagctgagcaagccacacaggatgtgaagaattggatgacagaaaccttgttggtccaaaatgcaaatccagattgcaagactatattaagagcattaggacaaggggcttcaatagaagaaatgatgacagcatgtcagggagtgggaggacctagtcataaagcaagagttttggctgaggcaatgagccaagtaacaaatacaaatacagccataatgatgcagaaaggcaactttaagggccaaagaaaatttgttaaatgcttcaactgtggcaaagagggacacatagccagaaattgcagggcccctaggaaaaagggctgttggaaatgtggaagagaaggacatcagatgaaagactgcacagagagacaggctaattttttagggaaaatttggccttccagcaaagggaggccaggaaattttctccagagcaggccagaaccaacagccccaccagcagagagcttcgggttcggagaggagatgaccccctctccgaagcaggagcagctgaaggacaaggaacctcccttagcttccctcagatcactctttggcagcgaccccttgttacagtaa

SEQ ID NO: 30 - DNA, 579 bp, Human immunodeficiency virus type 1
  isolate=90CR056; gene=vif
atggaaaacagatggcaggtgatgattgtgtggcaagtagacaggatgaggattaacacatggaaaagcttagtaaagtaccatatgcatatttcaaggaaagctagaggatggttttatagacatcattttgaaagcactcatccaaggataagttcagaagtacacatcccattaggagaagctaggttagtcataaccacatactggggtctgaatacaggagaaagagaatggcatttaggccagggagtctccatagaatggagactgaaaaggtatagcacacaagtagagcctggcctggcagaccaactaattcatatgcattattttgattgtttttcagaatctgccataaggaaagccatattaggacgtgtagttagacctaggtgtaactatccagcaggacataaacaggtaggaactctacaatacttggcattaacagcattagtggcaccaaaaaagataaagccacctttgcctagtgttagaaagctagtagaggatagatggaacaagccccagaagaccaggggccacagagggagccacacaatgaatggacactag

SEQ ID NO: 31 - DNA, 291 bp, Human immunodeficiency virus type 1
  isolate=90CR056; gene=vpr
atggaacaagccccagaagaccaggggccacagagggagccacacaatgaatggacactagagcttttagaggagattaagaatgaggctgttaggcattttcctagagtatggctccatcaattaggacagcatatctataacacctatggagatacttgggtaggagttgaagctttaataagaacgctgcaacaactactgtttattcatttcagaattgggtgccaacatagcagaataggaattactcgacagagaagagtaagaaatggacccagtagatcctaa

SEQ ID NO: 32 - DNA, 624 bp, Human immunodeficiency virus type 1
  isolate=92NG083; gene=nef
atggggggcaagtggtcaaaaagtagcatagttggatggcctcagataagggaaagaataagacaaactcctgtagcagcagaaggagtaggagcagtatctcaagatttagctaggcatggagcaatcacaagcagcaatacagcaaccaacaatcctgattgtgcctggctggaagcacaagaggaggactcagatgtaggctttccggtcagaccacaggtacctttgagaccaatgacttataaggctgcttttgatctcagcttctttttaaaagaaaaggggggactggatgggctaatttactccaagagaagacaagacatccttgatctatgggtctataatacacaaggattcttcccagattggcagaactacacaccagggccagggactagactcccactgacctttgggtggtgcttcaaactagtaccaatggacccagcagagatagaggaagccaataagggagagaacatcagtctattacaccccatctgccagcatggaatggaggatgaagacagagaagtgctggtatggagatttaacagtagcctagcacggagacacctagcccgagagctgcatccggagtactacaaagactgctga

SEQ ID NO: 33 - DNA, 2606 bp, Human immunodeficiency virus type 1
  isolate=90CR056; gene=tat; CDS: join (5177..5391, 7698..7782)
atggacccagtagatcctaaactagagccctggaaccatccaggaagtcagcctcaaactgcttgtaacaattgttattgtaaaaagtgctgctatcattgccaaatgtgctttttaaagaaaggcttaggaatttcctatggcaggaagaagcggagccagcgacacagaactcctgcaagtttgcaagatcatcaaaattctatatcaaagcagtaagtattatcataaatgtatatattaggattaggaataggagcgctagtagtaacatttatcatagccgtaattgtgtggaccatagtatatatagaatataaaaaattggtaaggcaaaagaaaatagacaggctaattgaaagaataggagaaagagcagaagacagtggcaacgagagtgatggagacacagaggaattatccaagcttatggagatggggcaccttaatcttgggtatgttgctgatctgtagtgctgcacaaaacttgtgggttacagtatattatggggtacctgtgtggaaagaggcaaaaaccactctattctgtgcatcagatgctaaggcatatgagacagaaaagcataatgtctgggctacacatgcatgtgtacccacagaccccaacccacaagagatggtcatggagaatgtaacagagagctttaatatgtgggaaaataacatggtggagcagatgcatacagacataatcagtttatgggatcaaagcttgaaaccatgtgtaaaattaaccccactctgtgttactctaaactgtactaatgtcagaaacaatacctctaacagcactagcagtatggaggcaggaggggaactaacaaattgctctttcaatgtaactacagtactaagagataagcagcagaaagtacatgcactcttttatagacttgatgtagtaccaattgataacaatagtactcagtataggctaataaattgtaatacctcagtcattacacaggcttgcccaaaggtgtcctttgaacctattcccatacattattgtgctccagctggctttgcgattctaaagtgtaacaataaaacattcaatggaacaggattatgtacaaatgtcagtacagtacaatgtacacatggaattagaccagtggtatcaactcaactgctattaaatggaagcctagcagaagaacagatcataattagaactaaaaatatctcagacaataccaaaaacataatagtacagcttaagacaccagtaaacattacatgtaccaggcctaacaataatacgagaacaagtatacatttagggccaggacgagcattctatgcaacaggtgacatcataggagatataagacaagcacattgtaatattagtagaacagactggaataagactttacaccaggtagttacacaattaggaatacacttgaacaatagaacaataagctttaagccaaactcaggaggggacatggaagttagaacacatagttttaattgtagaggagaatttttctattgcaatacatcagggctgtttaatagtagttgggaaatgcatactaattacacatcaaatgacacaaagggaaacgaaaacattacactgccatgcagaataaaacaaattgtaaacatgtggcagagagtaggacgagcaatgtatgcccctcccatccaaggaaacattatgtgtgtatcaaatattacaggactaatattgacaattgacgagggtaacgcgtctgcagaaaattataccttcagacctggaggaggagatatgagggacaattggagaagtgaattgtataaatataaagtagtaaaaattgaaccactgggaatagcacccaccaagacaaggagaagagtggtggagagagaaaaaagagcagtgggaatgggagcttctttccttgggttcttgggagcagcaggaagcactatgggcgcggcgtcaataacgctgacggtacaggccaggcaattattgtctggtatagtgcagcagcaaagcaatttgctgagagctatacaggcgcgacagcatatgttgcagctcacggtctggggcattaaacagctccaggcaagagtcctcgctgtggaaagatacctaagggatcaacagctcctggggatttggggctgctctggaaaactcatctgcaccactaatgtgccttggaactctagttggagtaataaatcacagagtgaaatctgggacaacatgacttggatggaatgggataaacaaattagcaattacacagaggaaatatacaggttgcttgaagtctcgcaaacccagcaggaaaagaatgaacaggacttattagcattggacaaatgggcaagtctgtggacttggtttgacatatcacattggctgtggtatataaaaatattcataatgatagtaggaggtttaataggtttaagaataatttttgctgtgctttctatagtaaatagagttaggcagggatactcacctttgtcttttcagacccttgtcccgaacccacggggacccgacaggcccgaaggaacagaagaaggaggtggcgagcaagacagagacagatccgtga

SEQ ID NO: 34 - DNA, 2657 bp, Human immunodeficiency virus type 1
  isolate=90CR056; gene=rev; CDS: join(5316..5391, 7698..7972)
atggcaggaagaagcggagccagcgacacagaactcctgcaagtttgcaagatcatcaaaattctatatcaaagcagtaagtattatcataaatgtatatattaggattaggaataggagcgctagtagtaacatttatcatagccgtaattgtgtggaccatagtatatatagaatataaaaaattggtaaggcaaaagaaaatagacaggctaattgaaagaataggagaaagagcagaagacagtggcaacgagagtgatggagacacagaggaattatccaagcttatggagatggggcaccttaatcttgggtatgttgctgatctgtagtgctgcacaaaacttgtgggttacagtatattatggggtacctgtgtggaaagaggcaaaaaccactctattctgtgcatcagatgctaaggcatatgagacagaaaagcataatgtctgggctacacatgcatgtgtacccacagaccccaacccacaagagatggtcatggagaatgtaacagagagctttaatatgtgggaaaataacatggtggagcagatgcatacagacataatcagtttatgggatcaaagcttgaaaccatgtgtaaaattaaccccactctgtgttactctaaactgtactaatgtcagaaacaatacctctaacagcactagcagtatggaggcaggaggggaactaacaaattgctctttcaatgtaactacagtactaagagataagcagcagaaagtacatgcactcttttatagacttgatgtagtaccaattgataacaatagtactcagtataggctaataaattgtaatacctcagtcattacacaggcttgcccaaaggtgtcctttgaacctattcccatacattattgtgctccagctggctttgcgattctaaagtgtaacaataaaacattcaatggaacaggattatgtacaaatgtcagtacagtacaatgtacacatggaattagaccagtggtatcaactcaactgctattaaatggaagcctagcagaagaacagatcataattagaactaaaaatatctcagacaataccaaaaacataatagtacagcttaagacaccagtaaacattacatgtaccaggcctaacaataatacgagaacaagtatacatttagggccaggacgagcattctatgcaacaggtgacatcataggagatataagacaagcacattgtaatattagtagaacagactggaataagactttacaccaggtagttacacaattaggaatacacttgaacaatagaacaataagctttaagccaaactcaggaggggacatggaagttagaacacatagttttaattgtagaggagaatttttctattgcaatacatcagggctgtttaatagtagttgggaaatgcatactaattacacatcaaatgacacaaagggaaacgaaaacattacactgccatgcagaataaaacaaattgtaaacatgtggcagagagtaggacgagcaatgtatgcccctcccatccaaggaaacattatgtgtgtatcaaatattacaggactaatattgacaattgacgagggtaacgcgtctgcagaaaattataccttcagacctggaggaggagatatgagggacaattggagaagtgaattgtataaatataaagtagtaaaaattgaaccactgggaatagcacccaccaagacaaggagaagagtggtggagagagaaaaaagagcagtgggaatgggagcttctttccttgggttcttgggagcagcaggaagcactatgggcgcggcgtcaataacgctgacggtacaggccaggcaattattgtctggtatagtgcagcagcaaagcaatttgctgagagctatacaggcgcgacagcatatgttgcagctcacggtctggggcattaaacagctccaggcaagagtcctcgctgtggaaagatacctaagggatcaacagctcctggggatttggggctgctctggaaaactcatctgcaccactaatgtgccttggaactctagttggagtaataaatcacagagtgaaatctgggacaacatgacttggatggaatgggataaacaaattagcaattacacagaggaaatatacaggttgcttgaagtctcgcaaacccagcaggaaaagaatgaacaggacttattagcattggacaaatgggcaagtctgtggacttggtttgacatatcacattggctgtggtatataaaaatattcataatgatagtaggaggtttaataggtttaagaataatttttgctgtgctttctatagtaaatagagttaggcagggatactcacctttgtcttttcagacccttgtcccgaacccacggggacccgacaggcccgaaggaacagaagaaggaggtggcgagcaagacagagacagatccgtgagattagtgaacggattcttaccagttgtctgggacgacctccggagcctgtcactcttcagctaccgcctcttgagagacttactcttaattgtagtgaggactgtggaacttctggggagaagggggagggaagccctcaaatatctctggaatcttctacaatactggggacaggaactaaagaatag

SEQ ID NO: 35 - DNA, 243 bp, Human immunodeficiency virus type 1
  isolate=90CR056; gene=vpu
atgtatatattaggattaggaataggagcgctagtagtaacatttatcatagccgtaattgtgtggaccatagtatatatagaatataaaaaattggtaaggcaaaagaaaatagacaggctaattgaaagaataggagaaagagcagaagacagtggcaacgagagtgatggagacacagaggaattatccaagcttatggagatggggcaccttaatcttgggtatgttgctgatctgtag

SEQ ID NO: 36 - DNA, 2538 bp, Human immunodeficiency virus type 1
  isolate=90CR056; gene=env
atggagacacagaggaattatccaagcttatggagatggggcaccttaatcttgggtatgttgctgatctgtagtgctgcacaaaacttgtgggttacagtatattatggggtacctgtgtggaaagaggcaaaaaccactctattctgtgcatcagatgctaaggcatatgagacagaaaagcataatgtctgggctacacatgcatgtgtacccacagaccccaacccacaagagatggtcatggagaatgtaacagagagctttaatatgtgggaaaataacatggtggagcagatgcatacagacataatcagtttatgggatcaaagcttgaaaccatgtgtaaaattaaccccactctgtgttactctaaactgtactaatgtcagaaacaatacctctaacagcactagcagtatggaggcaggaggggaactaacaaattgctctttcaatgtaactacagtactaagagataagcagcagaaagtacatgcactcttttatagacttgatgtagtaccaattgataacaatagtactcagtataggctaataaattgtaatacctcagtcattacacaggcttgcccaaaggtgtcctttgaacctattcccatacattattgtgctccagctggctttgcgattctaaagtgtaacaataaaacattcaatggaacaggattatgtacaaatgtcagtacagtacaatgtacacatggaattagaccagtggtatcaactcaactgctattaaatggaagcctagcagaagaacagatcataattagaactaaaaatatctcagacaataccaaaaacataatagtacagcttaagacaccagtaaacattacatgtaccaggcctaacaataatacgagaacaagtatacatttagggccaggacgagcattctatgcaacaggtgacatcataggagatataagacaagcacattgtaatattagtagaacagactggaataagactttacaccaggtagttacacaattaggaatacacttgaacaatagaacaataagctttaagccaaactcaggaggggacatggaagttagaacacatagttttaattgtagaggagaatttttctattgcaatacatcagggctgtttaatagtagttgggaaatgcatactaattacacatcaaatgacacaaagggaaacgaaaacattacactgccatgcagaataaaacaaattgtaaacatgtggcagagagtaggacgagcaatgtatgcccctcccatccaaggaaacattatgtgtgtatcaaatattacaggactaatattgacaattgacgagggtaacgcgtctgcagaaaattataccttcagacctggaggaggagatatgagggacaattggagaagtgaattgtataaatataaagtagtaaaaattgaaccactgggaatagcacccaccaagacaaggagaagagtggtggagagagaaaaaagagcagtgggaatgggagcttctttccttgggttcttgggagcagcaggaagcactatgggcgcggcgtcaataacgctgacggtacaggccaggcaattattgtctggtatagtgcagcagcaaagcaatttgctgagagctatacaggcgcgacagcatatgttgcagctcacggtctggggcattaaacagctccaggcaagagtcctcgctgtggaaagatacctaagggatcaacagctcctggggatttggggctgctctggaaaactcatctgcaccactaatgtgccttggaactctagttggagtaataaatcacagagtgaaatctgggacaacatgacttggatggaatgggataaacaaattagcaattacacagaggaaatatacaggttgcttgaagtctcgcaaacccagcaggaaaagaatgaacaggacttattagcattggacaaatgggcaagtctgtggacttggtttgacatatcacattggctgtggtatataaaaatattcataatgatagtaggaggtttaataggtttaagaataatttttgctgtgctttctatagtaaatagagttaggcagggatactcacctttgtcttttcagacccttgtcccgaacccacggggacccgacaggcccgaaggaacagaagaaggaggtggcgagcaagacagagacagatccgtgagattagtgaacggattcttaccagttgtctgggacgacctccggagcctgtcactcttcagctaccgcctcttgagagacttactcttaattgtagtgaggactgtggaacttctggggagaagggggagggaagccctcaaatatctctggaatcttctacaatactggggacaggaactaaagaatagtgctattgatttgcttaacaccacagcaatagcagtagctgagggaacagatgggattatagtaatagtgcaaagagcttggagagctattctccacatacctagaagaataagacagggctttgaaagaagcttgctataa

SEQ ID NO: 37 - DNA, 621 bp, Human immunodeficiency virus type 1
  isolate=90CR056; gene=nef
atgggaggcaaatggtcaaaaagtaggatgggtgggtggtctactataagggaaagaatgaggcgagctgaaccagtagcagaaggggtaggagcagtgtctcgagatttggatagacgcggggcagtcacaattaataatacagcatctactaatcgtgatgccgcctggctggaagcacaagaggacggggaggaagtaggctttccagtcaggcctcaggtacctttaagaccaatgacctataagggagcttttgatctcagccattttttaaaagaaaaggggggactggatgggttaatttactccaagcaaagacaggacatccttgatttatgggtctataacacacaaggctacttccctgactggcagaactacacaccagggccaggggagagatttcccctgacctttgggtggtgcttcaagctagtaccagtaaatccacaggaggtagaacaggccaatgaaggagagaacaacagcttgctacaccccatgagcctgcatggaatggaggatgacgggagagaagtgctgatgtggaaatttgacagtcgactagcattgacacacttggcccgagtaaagcatccggagtacaaagactgctga

SEQ ID NO: 38 - DNA, 1486 bp, Human immunodeficiency virus type 1
  isolate=92RW009; gene=gag
atgggtgcgagagcgtcaatattaagaggcggaaaattagatgcctgggaaaaaattaagttaaagccaggggggaaagaaaacatatatgatgaaacacctagtatgggcaagcagggagctggaaagatttgcacttaaccctgaccttttagagacaccagaaggctgtaaacaaataatgagacagctgcaaccagctcttcagacaggaacagatgaacttaggtcattatataatacagtagcaaccctctattgtgtacatcaaaagatagatgtaaaagacaccaaggaggccttagacaagatagaggaagaacaaaacaaaagtcagcaaaaaacacagcaggcagaagcagctgacaaaggaaaagtcagtcaaaattaccctatagtgcaaaatgcacaagggcaaatggtacaccaggccatatcacctagaactttgaatgcgtgggtaaaagtaatagaggagaaggcttttagccaagaggtaatacccatgtttacagcattatcagaaggagccaccccacaagatttaaacaccatgctaaatacagtggggggacatcaagcagccatgcaaatgctaaaagatacaatcaatgaggaggctgcagagtgggatagggtacatccagtgcaggcagggcctgttgcgccaggccagataagagaaccaaggggaagtgacatagcaggaactactagtacccttcaggaacaaatagcatggatgacaaataacccacctattccagtgggagaaatttataaaagatggataattctggggttaaataaaatagtaagaatgtatagccctgtcagcatattggacataaaacaagggccaaaggaaccttttagagactatgtagaccggttctttaaaaccttaagagccgaacaagcttcacaagatgtaaaaaattggatgacagataccttgttagtccaaaatgcgaacccagattgtaagaccattttaagagcattagggccaggggcttcattagaagaaatgatgacagcatgccagggagtgggaggacccggccataaagcaagggttttggctgaagcaatgagccaagtacaacaaccaaacataatgatgcagagaggcaattttaagggccagagaagaattattaagtgtttcaactgtggcaaagaaggacacctagccagaaattgcagggcccctagaaaaaagggctgttggaaatgtggaaaggagggacaccaaatgaaagactgcactgagagacaggctaattttttagggaaaatttggccttccaacaaggggaggccaggaaattttccccagagcagactggagccaacagccccaccagcagagaactttggaatgggggaagagatagcctctcctctgaaacaggagcagaaagacagggaacctttaatttccctcaaatcactctttggcaacgaccccttgtcacagtaa

SEQ ID NO: 39 - DNA, 579 bp, Human immunodeficiency virus type 1
  isolate=92RW009; gene=vif
atggaaaacagatggcaggtgatgattgtgtggcaggtagacaggatgaagattagaacatggaatagtctagtaaagcaccatatgtatgcttcaaggagagctaagggatggttttatagacatcattatgaaagcagacatccaaaaataagttcagaagtacacatcccattaggggaagctagattagtaataaaaacatattggggtttgcaaacaggggaaagagattggcatttgggtcatggagtctccatagaatggagattgagaagatataagacacaagtagaccctggcctggcaggccaactaatccatatgcattattttgattgttttgcagactctgccataaggaaagccatattaggacatatagttagccctaggtgtgactatcaagcaggacataataaggtaggatctctacaatacttggcactgacagcattgataaaaccaaaaaagataaagccacctctgcctagtgttagtaaattagtagaggataaatggaacaagccccagaagaccaggggccgcagagggaaccatacaatgaatggacactag

SEQ ID NO: 40 - DNA, 291 bp, Human immunodeficiency virus type 1
  isolate=92RW009; gene=vpr
atggaacaagccccagaagaccaggggccgcagagggaaccatacaatgaatggacactagagcttttagaggcactcaagcaggaagctgtcagacactttcctagaccatggctccatgacttaggacaatatatctatgaaacctatggggatacttggaggggagtagaagctataataagaattctgcaacaactactgtttatccatttcagaattgggtgccggcatagcagaataggcattttgcaacagagaagagcaagaaatggagccagtagatcctaa

SEQ ID NO: 41 - DNA, 2640 bp, Human immunodeficiency virus type 1
  isolate=92RW009; gene=tat
atggagccagtagatcctaaactagagccctggaaccatccaggaagtcagcctaaaactgcctgtaataactgttattgtaaacactgtagctatcattgtctagtttgcttccaggcaaaaggcttaggcatttcctatggcaggaagaagcggagacagcgacgaaacgctcctccaagcagtgaagatcatcaaaatcctatatcaaagcagtaagtagtaataaacagtatatgtaatgacttctttagaaatctatgcaatagtagcactgatagtggcgctaatcatagtgatagttgtgtggactttagcaggtatagaatataagaaattgctaaagcaaaggaaaatagataggttaattaagaaaataagagaaagagcagaagatagtggcaatgagagtgatggggacattgatgaattatcaaaacttgtgggggtggggaactatgatcttggggatgttaacaatttgtagtgctgcaaacaacttgtgggttactgtctactatggggtacctgtgtggaaagacgcagagaccaccttattttgtgcatcagatgctaaagcatatgatccagaaaagcataatgtctgggctacacatgcctgtgtacccatagaccccgacccacaagaaatacatttggaaaatgtgacagaagagtttaacatgtggaaaaataacatggtagagcagatgcatacagatataatcagtctatgggaccaaagcctaaagccatgtgtaaagttaacccctctctgcgttactttagagtgtaacaacatcaccaatgtcaacaacactgtcaacattacggatgacatgaaaggagaaataaaaaactgctctttcaatatgaccacagaattaagggataagaaacagagagtgtattcacttttttataggcttgatatagtacaaattaatagcaatagtaataacagtagtcataatcagtataggttaataaattgtaatacctcagccattacacaggcttgtccaaaggtatcctttgagccaattcccataaattattgtgccccagctggtttcgcgattctaaagtgtaaagataaaaagttcaatggaacagggccatgcaagaatgtcagcacagtacaatgcacacatggaatcaagccagtagtatcaactcagctgctgttaaatggcagtctagcagaagaagagataataattagatctgaaaatattacaaacaatgccaaaaccataatagtacaacttaacgagactgtacaaattaattgttccagacctaacaacaatacaagaaaaagtgtacatataggaccaggacaagcattttatgcaacaggtgacgtaataggggatataagacaagcatattgtactgtcaatggaacaaaatggaatagaactttacaaaaggtagcagaaaaattaagtcactactttgagaacattacaacaataatttttaagaactcctcagggggggatttagaaattacaacacatagttttaattgtggaggagaatttttctattgtaatacatcaggcttgtttaatagcacctggagtaaaagaaatggcacctggcagtcaaatggcacagaattaaatataacactcccatgcagaataaagcaaattataaatatgtggcagaggacaggacaagcaatgtatgcccctcccatccaaggagtaataagctgtgtatcaaacattacaggactactattaacaagagatggtggaaataataatactacaactgaaaccttcagacctggaggaggagatatgagggataattggagaagtgaactatataaatataaagtagtaaaaattgaaccactaggagtagcacccaccagggcaaagaggagagtggtggagagagaaaaaagagcagttggactgggagctgtcttcattgggttcttaggagcagcaggaagcactatgggcgcggcgtcaataacgctgacggtacaggccagacaattattgtctggcatagtgcaacagcaaagcaatttgctgagggctatagaggctcaacagcatctattaaaactcacagtctggggcattaaacagctccaggcaagagtcctggctctggaaagatacctaagggatcaacagctcctaggaatttggggctgctctggaaaactcatctgcaccactaatgtgccctggaactctagttggagtaataagactcagcaggaaatatgggataacatgacctggcagcaatgggataaagaaattggcaattacacacaaataatatatagtctaattgaagaatcgcagaaccagcaggaaaagaatgaacaagacttattggcattggacaagtgggcaaatctgtggaattggtttgacatatcaaattggctgtggtatataaaaatattcataatgatagtaggaggcttaataggtttaagaataatttttgctgtgctctctatagtgaacagagttaggcagggatactcaccattatcgtttcagacccttatcccaaacccgaggggacccgacaggctcggaggaatcgaagaagaaggtggagagcaagacagaggcagatccattcgattag

SEQ ID NO: 42 - DNA, 2658 bp, Human immunodeficiency virus type 1
  isolate=92RW009;  gene=rev
atggcaggaagaagcggagacagcgacgaaacgctcctccaagcagtgaagatcatcaaaatcctatatcaaagcagtaagtagtaataaacagtatatgtaatgacttctttagaaatctatgcaatagtagcactgatagtggcgctaatcatagtgatagttgtgtggactttagcaggtatagaatataagaaattgctaaagcaaaggaaaatagataggttaattaagaaaataagagaaagagcagaagatagtggcaatgagagtgatggggacattgatgaattatcaaaacttgtgggggtggggaactatgatcttggggatgttaacaatttgtagtgctgcaaacaacttgtgggttactgtctactatggggtacctgtgtggaaagacgcagagaccaccttattttgtgcatcagatgctaaagcatatgatccagaaaagcataatgtctgggctacacatgcctgtgtacccatagaccccgacccacaagaaatacatttggaaaatgtgacagaagagtttaacatgtggaaaaataacatggtagagcagatgcatacagatataatcagtctatgggaccaaagcctaaagccatgtgtaaagttaacccctctctgcgttactttagagtgtaacaacatcaccaatgtcaacaacactgtcaacattacggatgacatgaaaggagaaataaaaaactgctctttcaatatgaccacagaattaagggataagaaacagagagtgtattcacttttttataggcttgatatagtacaaattaatagcaatagtaataacagtagtcataatcagtataggttaataaattgtaatacctcagccattacacaggcttgtccaaaggtatcctttgagccaattcccataaattattgtgccccagctggtttcgcgattctaaagtgtaaagataaaaagttcaatggaacagggccatgcaagaatgtcagcacagtacaatgcacacatggaatcaagccagtagtatcaactcagctgctgttaaatggcagtctagcagaagaagagataataattagatctgaaaatattacaaacaatgccaaaaccataatagtacaacttaacgagactgtacaaattaattgttccagacctaacaacaatacaagaaaaagtgtacatataggaccaggacaagcattttatgcaacaggtgacgtaataggggatataagacaagcatattgtactgtcaatggaacaaaatggaatagaactttacaaaaggtagcagaaaaattaagtcactactttgagaacattacaacaataatttttaagaactcctcagggggggatttagaaattacaacacatagttttaattgtggaggagaatttttctattgtaatacatcaggcttgtttaatagcacctggagtaaaagaaatggcacctggcagtcaaatggcacagaattaaatataacactcccatgcagaataaagcaaattataaatatgtggcagaggacaggacaagcaatgtatgcccctcccatccaaggagtaataagctgtgtatcaaacattacaggactactattaacaagagatggtggaaataataatactacaactgaaaccttcagacctggaggaggagatatgagggataattggagaagtgaactatataaatataaagtagtaaaaattgaaccactaggagtagcacccaccagggcaaagaggagagtggtggagagagaaaaaagagcagttggactgggagctgtcttcattgggttcttaggagcagcaggaagcactatgggcgcggcgtcaataacgctgacggtacaggccagacaattattgtctggcatagtgcaacagcaaagcaatttgctgagggctatagaggctcaacagcatctattaaaactcacagtctggggcattaaacagctccaggcaagagtcctggctctggaaagatacctaagggatcaacagctcctaggaatttggggctgctctggaaaactcatctgcaccactaatgtgccctggaactctagttggagtaataagactcagcaggaaatatgggataacatgacctggcagcaatgggataaagaaattggcaattacacacaaataatatatagtctaattgaagaatcgcagaaccagcaggaaaagaatgaacaagacttattggcattggacaagtgggcaaatctgtggaattggtttgacatatcaaattggctgtggtatataaaaatattcataatgatagtaggaggcttaataggtttaagaataatttttgctgtgctctctatagtgaacagagttaggcagggatactcaccattatcgtttcagacccttatcccaaacccgaggggacccgacaggctcggaggaatcgaagaagaaggtggagagcaagacagaggcagatccattcgattagtgagcggattcttagcacttgcctgggacgacctacggagcctgtgccttttcagctaccaccgattgagagacttactattgattgcagcgaggacggtggaacttctgggacgcagcagtctcaggggactacagagggggtgggaaacccttaa

SEQ ID NO: 43 - DNA, 246 bp, Human immunodeficiency virus type 1
  isolate=92RW009; gene=vpu
atgacttctttagaaatctatgcaatagtagcactgatagtggcgctaatcatagtgatagttgtgtggactttagcaggtatagaatataagaaattgctaaagcaaaggaaaatagataggttaattaagaaaataagagaaagagcagaagatagtggcaatgagagtgatggggacattgatgaattatcaaaacttgtgggggtggggaactatgatcttggggatgttaacaatttgtag

SEQ ID NO: 44 - DNA, 2583 bp, Human immunodeficiency virus type 1
  isolate=92RW009; gene=env
atgagagtgatggggacattgatgaattatcaaaacttgtgggggtggggaactatgatcttggggatgttaacaatttgtagtgctgcaaacaacttgtgggttactgtctactatggggtacctgtgtggaaagacgcagagaccaccttattttgtgcatcagatgctaaagcatatgatccagaaaagcataatgtctgggctacacatgcctgtgtacccatagaccccgacccacaagaaatacatttggaaaatgtgacagaagagtttaacatgtggaaaaataacatggtagagcagatgcatacagatataatcagtctatgggaccaaagcctaaagccatgtgtaaagttaacccctctctgcgttactttagagtgtaacaacatcaccaatgtcaacaacactgtcaacattacggatgacatgaaaggagaaataaaaaactgctctttcaatatgaccacagaattaagggataagaaacagagagtgtattcacttttttataggcttgatatagtacaaattaatagcaatagtaataacagtagtcataatcagtataggttaataaattgtaatacctcagccattacacaggcttgtccaaaggtatcctttgagccaattcccataaattattgtgccccagctggtttcgcgattctaaagtgtaaagataaaaagttcaatggaacagggccatgcaagaatgtcagcacagtacaatgcacacatggaatcaagccagtagtatcaactcagctgctgttaaatggcagtctagcagaagaagagataataattagatctgaaaatattacaaacaatgccaaaaccataatagtacaacttaacgagactgtacaaattaattgttccagacctaacaacaatacaagaaaaagtgtacatataggaccaggacaagcattttatgcaacaggtgacgtaataggggatataagacaagcatattgtactgtcaatggaacaaaatggaatagaactttacaaaaggtagcagaaaaattaagtcactactttgagaacattacaacaataatttttaagaactcctcagggggggatttagaaattacaacacatagttttaattgtggaggagaatttttctattgtaatacatcaggcttgtttaatagcacctggagtaaaagaaatggcacctggcagtcaaatggcacagaattaaatataacactcccatgcagaataaagcaaattataaatatgtggcagaggacaggacaagcaatgtatgcccctcccatccaaggagtaataagctgtgtatcaaacattacaggactactattaacaagagatggtggaaataataatactacaactgaaaccttcagacctggaggaggagatatgagggataattggagaagtgaactatataaatataaagtagtaaaaattgaaccactaggagtagcacccaccagggcaaagaggagagtggtggagagagaaaaaagagcagttggactgggagctgtcttcattgggttcttaggagcagcaggaagcactatgggcgcggcgtcaataacgctgacggtacaggccagacaattattgtctggcatagtgcaacagcaaagcaatttgctgagggctatagaggctcaacagcatctattaaaactcacagtctggggcattaaacagctccaggcaagagtcctggctctggaaagatacctaagggatcaacagctcctaggaatttggggctgctctggaaaactcatctgcaccactaatgtgccctggaactctagttggagtaataagactcagcaggaaatatgggataacatgacctggcagcaatgggataaagaaattggcaattacacacaaataatatatagtctaattgaagaatcgcagaaccagcaggaaaagaatgaacaagacttattggcattggacaagtgggcaaatctgtggaattggtttgacatatcaaattggctgtggtatataaaaatattcataatgatagtaggaggcttaataggtttaagaataatttttgctgtgctctctatagtgaacagagttaggcagggatactcaccattatcgtttcagacccttatcccaaacccgaggggacccgacaggctcggaggaatcgaagaagaaggtggagagcaagacagaggcagatccattcgattagtgagcggattcttagcacttgcctgggacgacctacggagcctgtgccttttcagctaccaccgattgagagacttactattgattgcagcgaggacggtggaacttctgggacgcagcagtctcaggggactacagagggggtgggaaacccttaagtatctaggaaatcttgtgcagtattggggtctggaactaaaaaggagtgctattaatctgcttgataccacagcaatagtagtagctgaaggaacagataggattatagaattaatacaaagaattagcagagctatctataacatacctagcagaataagacagggctttgaagcagctttgcaataa

SEQ ID NO: 45 - DNA, 624 bp, Human immunodeficiency virus type 1
  isolate=92RW009; gene=nef
atgggaagcaagtggtcaaaatgtagtccagtaggatggcctgctgtaagagaaagactaaggcaaactgagccagcagcagagggagtaggagcagcgtctcaagacctagacaaatatggggcacttacaagtagcaacacacccagcaacaatgctgattgtgcctggctggcagcacaagaggaggaaaacgaagtaggctttccagtcagacctcaggtgcctttaagaccaatgacttataaagcagcagttgatctcagcttctttttaaaagaaaaggggggactggaagggttaatttactctaagaaaaggcaagacatcctggatttgtgggtctataacacacaaggctacttccctgattggcaaaactacacaccaggaccaggggtcagatatccactgacttttggatggtgttacaagctagtgccagttgacccaagggaagtggaagaagccaatgaaggagaggacaactgcttactacaccctctgagccagcatggaatggaggatgaggacagagaagtcttaaagtggaagtttgacagtcacctagcacacagacacatggcccgcgagctacatccggagtattataaagactgctga

SEQ ID NO: 46 - DNA, 8 bp, Human immunodeficiency virus type 1
  isolate=92RW009; standard name=3' LTR repeat region; note=3' R repeat should end one base beyond end of this
aaaaaaaa

SEQ ID NO: 47 - DNA, 1494 bp, Human immunodeficiency virus type 1
  isolate=92NG003; gene=gag
atgggtgcgagagcgtcagtattaagcgggggaaaattagatgcatgggaaaaaattcggttgaggccagggggaaagaaaaaatatagaatgaaacatttagtatgggcaagcagggaactggagagatttgcacttaaccctgacctcttagaaacaacagaaggttgtcagcaaataatgagacagctgcaaccatctctccagacaggaacagaggagattaaatcattatttaatacagtagcaaccctctattgtgtacatcaaaggatagaggtaaaagacaccaaagaagctctagaggaagtggaaaaaatacaaaagaacagtcagcaagaaacacagaaggcagcaatgggtaaaggaaacagcagccaagttagccaaaattatcctatagtgcagaatgcacaagggcaagtggtacaccagcccatatcacctaggactttaaatgcatgggtaaaagtaatagaagaaaagaacttcagtccagaagtaatacccatgtttacagcattatcagaaggagccaccccacaagatttgaataccatgctaaacaccgtgggggggcatcaagcagctatgcaaatgctaaaagattctattaatgaagaagctgcagagtgggataggctacatccacaacaggcaggacctattccaccaggccagataagagaaccaaggggaagtgatatagcaggaactactagtaccctgcaggaacaaataacatggatgaccagcaacccacctatcccagtgggagaaatttataaaagatggataattctggggttaaataaaatagtgagaatgtatagccctgtcagtattttagacataaaacaagggccaaaagaacccttcagagattatgtggataggttctttaaaactttgagagctgagcaagccacacaggaggtaaaaaactggatgacagacaccttgttggtccaaaatgcgaacccagattgtaagaccatcctaagagcattaggagcaggagctacactagaagaaatgttgacagcatgtcaaggagtgggaggacccagccacaaagcaagagttttagctgaggcaatgagccgggcaacaggtacatcagcagccataatgatgcagaaaaacaattttaagggcccgagaagaggtattaagtgtttcaactgtggcaaggaaggacatctagccagaaattgcagggcccctaggaaaaaaggctgttggaaatgtggaaaggagggacatcaaatgaaagactgcacagagagacaggctaattttttagggaaaatttggccttccaacaaggggaggccagggaattttcttcagaacaggccagagccaacagccccacccgcagagagcttcgggttcggagaggagatagccccttccctgaagcaggagccgagggaaaaggaatcacctccattaacctccctcaaatcactctttggcaacgacccctag

SEQ ID NO: 48 - DNA, 4307 bp, Human immunodeficiency virus type 1
  isolate=92NG003; gene=gag-pol fusion
atgggtgcgagagcgtcagtattaagcgggggaaaattagatgcatgggaaaaaattcggttgaggccagggggaaagaaaaaatatagaatgaaacatttagtatgggcaagcagggaactggagagatttgcacttaaccctgacctcttagaaacaacagaaggttgtcagcaaataatgagacagctgcaaccatctctccagacaggaacagaggagattaaatcattatttaatacagtagcaaccctctattgtgtacatcaaaggatagaggtaaaagacaccaaagaagctctagaggaagtggaaaaaatacaaaagaacagtcagcaagaaacacagaaggcagcaatgggtaaaggaaacagcagccaagttagccaaaattatcctatagtgcagaatgcacaagggcaagtggtacaccagcccatatcacctaggactttaaatgcatgggtaaaagtaatagaagaaaagaacttcagtccagaagtaatacccatgtttacagcattatcagaaggagccaccccacaagatttgaataccatgctaaacaccgtgggggggcatcaagcagctatgcaaatgctaaaagattctattaatgaagaagctgcagagtgggataggctacatccacaacaggcaggacctattccaccaggccagataagagaaccaaggggaagtgatatagcaggaactactagtaccctgcaggaacaaataacatggatgaccagcaacccacctatcccagtgggagaaatttataaaagatggataattctggggttaaataaaatagtgagaatgtatagccctgtcagtattttagacataaaacaagggccaaaagaacccttcagagattatgtggataggttctttaaaactttgagagctgagcaagccacacaggaggtaaaaaactggatgacagacaccttgttggtccaaaatgcgaacccagattgtaagaccatcctaagagcattaggagcaggagctacactagaagaaatgttgacagcatgtcaaggagtgggaggacccagccacaaagcaagagttttagctgaggcaatgagccgggcaacaggtacatcagcagccataatgatgcagaaaaacaattttaagggcccgagaagaggtattaagtgtttcaactgtggcaaggaaggacatctagccagaaattgcagggcccctaggaaaaaaggctgttggaaatgtggaaaggagggacatcaaatgaaagactgcacagagagacaggctaattttttagggaaaatttggccttccaacaaggggaggccagggaattttcttcagaacaggccagagccaacagccccacccgcagagagcttcgggttcggagaggagatagccccttccctgaagcaggagccgagggaaaaggaatcacctccattaacctccctcaaatcactctttggcaacgacccctagtcacagtaagaatagggggacagctaatagaagctctattagacacaggagcagatgatacagtattagaacaaataaatttaccaggaaaatggaaaccaaaaatgatagggggaattggaggatttatcaaagtaaaacagtatgatcaaatacttatagaaattgaagggaaaaaggctatagggacagtactagtaggacctacacctatcaacataattgggagaaatatgttgactcaaattggttgtactttaaattttccaattagtcctattgagactgtaccagtaaaattaaaaccaggaatagatggcccaaaggttaaacaatggccattgacagaagagaaaataaaagcattaacagaaatttgtacagatatggaaaaggaaggaaaaatttcaaaaattgggccagaaaatccatacaacactccaatatttgccataaagaaaaaagacagtactaaatggagaaagttggtagatttcagagagctcaataaaagaactcaagacttctgggaggtccaattaggcatacctcatcccgcggggttaaaaaagaaaagatcagtaacagtactagatgtgggggatgcatatttttcaattcccctagatgaaaactttagaaagtatacagcattcactatacctagtataaataatgagacaccagggattagatatcagtacaatgtgcttccgcaaggatggaaaggatcaccagcaatatttcagagtagcatgacaaaaatcttagaaccctttagaacagaaaatccagaaatagtgatctatcagtacatggatgatttatatgtaggatctgacttagaaacagggcagcatagagcaaaaatagaggaattaagaaatcatctactgagatggggatttaccacaccagataaaaaacatcagaaagaacctccatttctctggatgggatatgagctccatcctgacaaatggacggtacaacctatacagctgccaaacaaagaaagctggactgtcaatgatatacaaaaattagtgggaaaactaaattgggcaagtcagatttatccagggattaaagtaaagcaactatgtaaactccttaggggggccaaagcactaacagacatagtaccactgactgaagaagcagaattagaattggcagagaacagggaaattctaaaagaacctgtacatggagtctactatgacccatcaaaagaattaatagcagaattacagaaacaagggtgcgaccaatggacatatcaaatttatcaagagccatacaaaaatctgaaaacaggaaagtatgcaaaaagggggtctgcccacactaatgatgtaaaacagttaacagaagcagtgcaaaaaatagccacagagagcatagtaatatggggaaaagttcctaaatttaaactacctataaggaaagaaacatgggaagtatggtggacagaatattggcaggccacctggattcctgattgggagtttgtcaatacccctcctctagtaaagttatggtatcgattagaaacagaacccataccaggagcagaaacttactatgtagatggggcagctaataaagaaacaaaattaggaaaggcaggatatgttactgacagaggaaaacaaaaaattatcaccatacaggaaacaacaaatcaaaaaactgaattacacgcaattcagctagctttgcaggattcaggatcagaagtaaacatagtaacagactcacagtatgcattaggaatcattcaagcacaaccagataggagtgaatcagaattagtcaatcaaataatagaacagctaataaaaaaggaaaaggtctacttaacatgggtaccagcacacaaaggaattgggggaaatgaacaagtagataaattagtcagtagtggaatcagaaaagtactgtttttagatggcatagacaaagctcaagaggaccatgaaagatatcacagcaattggagagcaatggctagtgattttaatctgccacctatagtagcaaaagaaatagtggccagctgtgataaatgtcagctaaaaggggaagccatgcatggacaagtagactgtagtccaggaatatggcaattagattgcacacatctagaaggaaaagtcattatagtagcagtccatgtagccagtggctatatagaagcagaagttatcccagcagaaacaggacaggagacagcatacttcctgctaaaattagcaggaagatggccagtaaaagtaatacacacagacaatggcagcaatttcaccagtgctgcaatgaaagcagcctgttggtgggcaaatatccaacaggaatttggaattccctacaatccccaaagccaaggagtagtggaatctatgaataaagaattaaagaaaattatagggcaggtcagggatcaagctgaacacctcaagacagcagtacagatggcagtattcattcacaattttaaaagaaaaggggggattggggggtacagtgcaggggaaagaataatagacataatagcatcagatatacaaactaaagaactacaaaaacagattataaaaattcaaaattttcgggtctattacagggacagcagagaccccatttggaaaggaccagcaaaactactctggaaaggtgaaggggcagtagtaatacaggacaatagtgagataaaggtagtaccaagaagaaaagtaaaaatcattaaggattatggaaaacagatggcaggtggtgattgtgtggcaggtagacaggatgaggattag

SEQ ID NO: 49 - DNA, 579 bp, Human immunodeficiency virus type 1
  isolate=92NG003; gene=vif
atggaaaacagatggcaggtggtgattgtgtggcaggtagacaggatgaggattagaacatggaacagtttagtaaaatatcatatgtataaatctaagaaagctaaggattggttttatagacatcactatgaaagtaggcatccaaaagtaagttcagaagtacacatcccactaggggaggctagattagtagtaagaacatattggggtctgcatacaggagaaagagactggcacttgggtcagggggtctccatagaatggaagcagagaagatatagcacacaaatagatcctgacctagcagaccaactgattcacctgcattattttaactgtttttcagaatcggccgtaaggaaagccatactaggagaagtagttagacctaggtgtgaatatcaaacaggacataatcaggtaggatcactacaatatttagcactcaaagcattagtaacaccaacacagacaaagccacctttacctagtgttaagaagttaacagaagatagatggaacgagccccagaagaccaggggccacagagggagccattcaacgaatggacactag

SEQ ID NO: 50 - DNA, 114 bp, Human immunodeficiency virus type 1
  isolate=92NG003; gene=vpr
atggaacgagccccagaagaccaggggccacagagggagccattcaacgaatggacactagaactgttagaagaacttaaacatgaagctgttagacatggcttcatggattag

SEQ ID NO: 51 - DNA, 2579 bp, Human immunodeficiency virus type 1
  isolate=92NG003; gene=tat
atggagctggtagatcctagcctagagccctggaaccacccaggaagtcagcctacaactgcttgtaacaaatgttactgtaaaatatgctgctggcattgccaattgtgctttctgaacaagggcttaggcatctcctatggcaggaagaagcggagacgccgacgaggaactcctcagagtcaccaggatcatcaaaatcctgtaccaaagcagtgagtagtaatagttagtatatgtgatgcaatccttagaaatagctgcaatagcaggactagtagtagcagccatagcagccatagttgtgtggaccatagaaaaataaagaaacaggagaaaatagacaggttacttgatagaataagagaaagagcagaagatagtggcaatgagagtgaaggggacacagaggaattggcaacacttgtggacatggtggactttgatccttgggttggtgataatttgtagtgcctcaaataacttgtgggtcacagtctattatggggtaccagtgtgggaagacgcagatacccctctattttgtgcatctgatgctaaagcatatagtactgaaagacataatgtctgggccacacatgcctgtgtacccacagaccccaacccacaagagataactctggaaaatgtaacagaaacttttaacatgtggaaaaataacatggtagaacagatgcatgaggatataatcagtttatgggatgaaagcctaaagccatgtgtaaagctaacccctctctgtgttaccttaaactgtactaatgtcaattgtaacagtaatgtgaccagcactgggaacagtgctgggaccaacgctacgtgtaacatagaagaagcaaacaacttaaaaaactgctctttcaatataaccacagaaataagagataagaaaaagacagaatatgcgcttttctatagacttgatgtggtaccaatcgatggtaataataatgtctcaaataactataggctaataaattgtaatgtctcaaccattaaacaagcttgtccaaaggtgtcttttgacccacttcccatacattattgtgctccagctgggtttgcgattttaaagtgtaggggtaagaatttcactggaacaggacaatgtaaaaatgtcagttcagtacaatgtacacatggaattaaaccagtggtatcaactcaattactactaaatggtagtctagcagaaggagaaatagtaattagatctgaaaacctcacagacaatgccaaagtcataatagtacagcttaataaaactataggaattaattgtaccagacccaacaacaatacaagaaaaagtataagaatcggacctggacaagcgttctatgcaacaggtgaaataataggacaagaatggcaggagatgttacagaaggtacaggcacaactagaacaggtctttaacaaaagtataacctttaactcatccgcaggaggggacctagaaattacaacacatagttttaattgtagaggagaatttttctattgtaatacatcaggattgtttaatgaatcaggagggaatgataccactatcacactcccatgtaagataaaacaaattgtgagaatgtggcagagagtgggacaagcaatgtatgcccctcccatcgcaggagatattacatgtagatcaaacattacagggctattattaacaagagatggtggggttaataatactggaaatgagaccttcagacctggaggaggagatatgagggacaattggagaagtgaattatataagtataaaatagtaaaaattaaaccactaggaatagcacccaccaaggcaaggagaagagtggtggagagaggaaaaagggcagttggactgggagctgtcttccttgggttcttaggagcagcaggaagcactatgggcgcggggtcaataacgctgacggtacaggtcagacaattattgtctggcatagtgcaacagcaaagcaatttgctgagggctatagaggcgcagcaacatctattgcaactcacagtctggggcattaaacagctccaggcaagagtcctggctgtagaaagatacctaaaggatcaacagctcctagggatttggggctgctctggaaaactcatctgcaccactaatgtgccttggaacactagttggagtaataaatcttatgaggagatttgggataacatgacctggatacaatgggaaagggaagtcagcaattacacacaacaaatatacagcctaattgaagaatcgcagaaccagcaggaaaagaatgaacaagacttattggcattggacaagtgggcaagtttgtggaactggtttgacataacaaaatggctatggtatataaaaatatttataatgatagtaggaggtttaataggtttaagaatagtttttgctgtgctttctatagtaaatagagttaggcagggatactcacctttgtcattccagacccttacccaccaccagagggaacccgacaggcccgaaagaatcgaagaaggaggtggagagcaagacagagacagatcagtgcgcttag

SEQ ID NO: 52 - DNA, 2645 bp, Human immunodeficiency virus type 1
  isolate=92NG003; gene=rev
atggcaggaagaagcggagacgccgacgaggaactcctcagagtcaccaggatcatcaaaatcctgtaccaaagcagtgagtagtaatagttagtatatgtgatgcaatccttagaaatagctgcaatagcaggactagtagtagcagccatagcagccatagttgtgtggaccatagaaaaataaagaaacaggagaaaatagacaggttacttgatagaataagagaaagagcagaagatagtggcaatgagagtgaaggggacacagaggaattggcaacacttgtggacatggtggactttgatccttgggttggtgataatttgtagtgcctcaaataacttgtgggtcacagtctattatggggtaccagtgtgggaagacgcagatacccctctattttgtgcatctgatgctaaagcatatagtactgaaagacataatgtctgggccacacatgcctgtgtacccacagaccccaacccacaagagataactctggaaaatgtaacagaaacttttaacatgtggaaaaataacatggtagaacagatgcatgaggatataatcagtttatgggatgaaagcctaaagccatgtgtaaagctaacccctctctgtgttaccttaaactgtactaatgtcaattgtaacagtaatgtgaccagcactgggaacagtgctgggaccaacgctacgtgtaacatagaagaagcaaacaacttaaaaaactgctctttcaatataaccacagaaataagagataagaaaaagacagaatatgcgcttttctatagacttgatgtggtaccaatcgatggtaataataatgtctcaaataactataggctaataaattgtaatgtctcaaccattaaacaagcttgtccaaaggtgtcttttgacccacttcccatacattattgtgctccagctgggtttgcgattttaaagtgtaggggtaagaatttcactggaacaggacaatgtaaaaatgtcagttcagtacaatgtacacatggaattaaaccagtggtatcaactcaattactactaaatggtagtctagcagaaggagaaatagtaattagatctgaaaacctcacagacaatgccaaagtcataatagtacagcttaataaaactataggaattaattgtaccagacccaacaacaatacaagaaaaagtataagaatcggacctggacaagcgttctatgcaacaggtgaaataataggacaagaatggcaggagatgttacagaaggtacaggcacaactagaacaggtctttaacaaaagtataacctttaactcatccgcaggaggggacctagaaattacaacacatagttttaattgtagaggagaatttttctattgtaatacatcaggattgtttaatgaatcaggagggaatgataccactatcacactcccatgtaagataaaacaaattgtgagaatgtggcagagagtgggacaagcaatgtatgcccctcccatcgcaggagatattacatgtagatcaaacattacagggctattattaacaagagatggtggggttaataatactggaaatgagaccttcagacctggaggaggagatatgagggacaattggagaagtgaattatataagtataaaatagtaaaaattaaaccactaggaatagcacccaccaaggcaaggagaagagtggtggagagaggaaaaagggcagttggactgggagctgtcttccttgggttcttaggagcagcaggaagcactatgggcgcggggtcaataacgctgacggtacaggtcagacaattattgtctggcatagtgcaacagcaaagcaatttgctgagggctatagaggcgcagcaacatctattgcaactcacagtctggggcattaaacagctccaggcaagagtcctggctgtagaaagatacctaaaggatcaacagctcctagggatttggggctgctctggaaaactcatctgcaccactaatgtgccttggaacactagttggagtaataaatcttatgaggagatttgggataacatgacctggatacaatgggaaagggaagtcagcaattacacacaacaaatatacagcctaattgaagaatcgcagaaccagcaggaaaagaatgaacaagacttattggcattggacaagtgggcaagtttgtggaactggtttgacataacaaaatggctatggtatataaaaatatttataatgatagtaggaggtttaataggtttaagaatagtttttgctgtgctttctatagtaaatagagttaggcagggatactcacctttgtcattccagacccttacccaccaccagagggaacccgacaggcccgaaagaatcgaagaaggaggtggagagcaagacagagacagatcagtgcgcttagtgagcggattcttagcacttgcctgggacgacctgcggaacctgtgcctcttcagctaccaccgattgagagacttagtcttgattgcagcgaggacagcagaactcctgagacgcagcagtctccagggactgagactggggtgggagggcctcaaatatctgtggaatctcctgttgtattggggtcgggaactaaagaatag

SEQ ID NO: 53 - DNA, 230 bp, Human immunodeficiency virus type 1
  isolate=92NG003; gene=vpu
atgcaatccttagaaatagctgcaatagcaggactagtagtagcagccatagcagccatagttgtgtggaccatagaaaaataaagaaacaggagaaaatagacaggttacttgatagaataagagaaagagcagaagatagtggcaatgagagtgaaggggacacagaggaattggcaacacttgtggacatggtggactttgatccttgggttggtgataatttgtag

SEQ ID NO: 54 - DNA, 2538 bp, Human immunodeficiency virus type 1
  isolate=92NG003; gene=env
atgagagtgaaggggacacagaggaattggcaacacttgtggacatggtggactttgatccttgggttggtgataatttgtagtgcctcaaataacttgtgggtcacagtctattatggggtaccagtgtgggaagacgcagatacccctctattttgtgcatctgatgctaaagcatatagtactgaaagacataatgtctgggccacacatgcctgtgtacccacagaccccaacccacaagagataactctggaaaatgtaacagaaacttttaacatgtggaaaaataacatggtagaacagatgcatgaggatataatcagtttatgggatgaaagcctaaagccatgtgtaaagctaacccctctctgtgttaccttaaactgtactaatgtcaattgtaacagtaatgtgaccagcactgggaacagtgctgggaccaacgctacgtgtaacatagaagaagcaaacaacttaaaaaactgctctttcaatataaccacagaaataagagataagaaaaagacagaatatgcgcttttctatagacttgatgtggtaccaatcgatggtaataataatgtctcaaataactataggctaataaattgtaatgtctcaaccattaaacaagcttgtccaaaggtgtcttttgacccacttcccatacattattgtgctccagctgggtttgcgattttaaagtgtaggggtaagaatttcactggaacaggacaatgtaaaaatgtcagttcagtacaatgtacacatggaattaaaccagtggtatcaactcaattactactaaatggtagtctagcagaaggagaaatagtaattagatctgaaaacctcacagacaatgccaaagtcataatagtacagcttaataaaactataggaattaattgtaccagacccaacaacaatacaagaaaaagtataagaatcggacctggacaagcgttctatgcaacaggtgaaataataggacaagaatggcaggagatgttacagaaggtacaggcacaactagaacaggtctttaacaaaagtataacctttaactcatccgcaggaggggacctagaaattacaacacatagttttaattgtagaggagaatttttctattgtaatacatcaggattgtttaatgaatcaggagggaatgataccactatcacactcccatgtaagataaaacaaattgtgagaatgtggcagagagtgggacaagcaatgtatgcccctcccatcgcaggagatattacatgtagatcaaacattacagggctattattaacaagagatggtggggttaataatactggaaatgagaccttcagacctggaggaggagatatgagggacaattggagaagtgaattatataagtataaaatagtaaaaattaaaccactaggaatagcacccaccaaggcaaggagaagagtggtggagagaggaaaaagggcagttggactgggagctgtcttccttgggttcttaggagcagcaggaagcactatgggcgcggggtcaataacgctgacggtacaggtcagacaattattgtctggcatagtgcaacagcaaagcaatttgctgagggctatagaggcgcagcaacatctattgcaactcacagtctggggcattaaacagctccaggcaagagtcctggctgtagaaagatacctaaaggatcaacagctcctagggatttggggctgctctggaaaactcatctgcaccactaatgtgccttggaacactagttggagtaataaatcttatgaggagatttgggataacatgacctggatacaatgggaaagggaagtcagcaattacacacaacaaatatacagcctaattgaagaatcgcagaaccagcaggaaaagaatgaacaagacttattggcattggacaagtgggcaagtttgtggaactggtttgacataacaaaatggctatggtatataaaaatatttataatgatagtaggaggtttaataggtttaagaatagtttttgctgtgctttctatagtaaatagagttaggcagggatactcacctttgtcattccagacccttacccaccaccagagggaacccgacaggcccgaaagaatcgaagaaggaggtggagagcaagacagagacagatcagtgcgcttagtgagcggattcttagcacttgcctgggacgacctgcggaacctgtgcctcttcagctaccaccgattgagagacttagtcttgattgcagcgaggacagcagaactcctgagacgcagcagtctccagggactgagactggggtgggagggcctcaaatatctgtggaatctcctgttgtattggggtcgggaactaaagaatagtgctattaatttgattgatacaatagcaatagcagtagctaactggacagatagggttatagaagtagcacaaggagcttgtagagctattctcaacatacctagaaggataagacaaggcttggaaagagctttgctataa

SEQ ID NO: 55 - DNA, 621 bp, Human immunodeficiency virus type 1
  isolate=92NG003; gene=nef
ataggaggcaagtggtcaaaaagtagcatagttggatggcccgcggtaagggagagaataagacaaacccctccagcagaaggagtaggagcagcacctcaagacttagctaggcatggagcaatcacaagcagcaatacagcacaaactaatcctgattgtgcctggctagaagcacaacaggagaattcagaggtaggctttccagtcagacaacaggtacctttgagaccaatgacttataaggctgcctttgatctcagcttctttttaaaagaaaaggggggactggatgggctaatttactctaagaaaagacaagacatccttgacctatgggtctataatacacaaggatacttcccagattggcagaactacactccagggccagggactagattcccactgacatttcggtggtgcttcaaactagtaccaatggatccagcagagatagaggaagccaataaaggagagaacaacagtttattacaccctatctgccaacatggcctggaagatgcggacagagaagtgctggtatggagatttgacagtagcctagcacggagacacatagcccgagaacaacatccggagtactataaggactgctga

SEQ ID NO: 56 - DNA, 1438 bp, Human immunodeficiency virus type 1
  isolate=93BR029; gene=gag
atgggtgcgagagcgtcagtaataagcgggggagaattagataaatgggaaaaaattaggttaaggccaggaggacataaaaaatatagattaaaacatatagtatgggcaagcaggggagctagaacgattcgcagttaatcctggccttttagagacatcagaaggctgtagacaaatactggaacagctacaaccagcccttaagacgggatcagaagaacttagatcattatataatacagtagcaaccctctattgtgtacatcaaaagatagatgtaaaagacaccaaggaagctttagaaaagatagaggaagagcaaaacaaagtaagaaaaaggcacagcaagcagcagctaacacaggaaacaacagccaggtcagccaaaattaccctatagtgcagaaccttcaggggcaaatggtacaccaggccatatcacctagaactttaaatgcatgggtaaaagtagtagaagagaaggcttttagcccagaagtaatacccatgttttcagcattatcagaaggagccaccccacaagatttaaacaccatgctaaacacagtggggggacatcaagcagctatgcaaatgttaaaagaaaccatcaatgaggaagctgcagaatgggacagagtacatccagtgcatgcaggacctatcccaccaggccagatgagggaacctaggggaagtgatatagctggaactactagtacccttcaggaacaaatacaatggatgacaagcaacccacctgtcccagtgggagaaatttataaaagatggatcatcctaggattaaataaaatagtaagaatgtatagccctaccagcattctgggcataagacaaggaccaaaggaaccctttagagactatgtagatcgattttataaaactctaagagcagagcaaacttcacaggatgtaaaaaattggatgacagaaaccttgttggtccaaaatgcgaacccagattgcaaaaccattttaaaagcattgggaccagcagctacactagaagaaatgatgacagcatgtcagggagtggggggacccggccataaagcaagagttttggcagaagcaatgagccaagtaacaaattcaggtaccataatgatgcagagaggcaattttaggaaccaaagaaagactattaagtgtttcaattgtggcaaagaagggcacatagccaaaaattgcagggcccctaggaaaaagggctgctggaaatgtggaaaggaaggacaccagatgaaagattgtactgagagacaggctaattttttagggaaaatctggccttcccacaagggaaggccagggaatttccttcagagcagaccagagccaacagccccaccagcagagagcttcaggtttggggaagaggtaacaactccctctcagaaacaggagccgatag

SEQ ID NO: 57 - DNA, 3012 bp, Human immunodeficiency virus type 1
  isolate=93BR029; gene=pol; note=NH2-terminus uncertain
ttttttagggaaaatctggccttcccacaagggaaggccagggaatttccttcagagcagaccagagccaacagccccaccagcagagagcttcaggtttggggaagaggtaacaactccctctcagaaacaggagccgatagacaaggagatgtatcctttggcttccctcagatcactctttggcaacgacccctcgtcacagtaaagataggggggcaactaaaggaagccctattagataccggagcagatgatacagtattagaagaaataaatttaccaggaagatggaaaccaaaaatgatagggggaattggaggttttatcaaagtaagacagtatgatcaaatacccatagaaatttgtggacgtaaagctacaggtacagtattagtaggacctacacctgtcaacataattggaagaaatctgttgactcagattggctgcactttaaattttcccattagtcctattgaaactgtaccagtaaaattgaagccaggaatggatggcccaagggttaaacaatggccattgacagaagaaaaaataaaagcattaacagaaatatgtacagaaatggaaaaagaaggaaaaatttcaaaaattgggcccgaaaatccatacaatactccagtatttgccataaagaaaaaagatagtactaaatggagaaaattagtagatttcagagaacttaataagagaactcaagacttctgggaagttcagttagggataccacatcccgcagggttaaagaagaaaaaatcagtaacagtactggatgtgggtgatgcatatttttcagttccattagataaagacttcaggaagtatactgcatttaccatacctagtacaaacaatgaaacaccagggcttagatatcagtacaatgtgcttccacaggggtggaaaggatcaccagcaatattccaaagtagcatgacaaaaatcttagagccttttagaaaacaaaatccagacatagttatctatcaatacatggatgatttgtatgtaggatctgacttagaaatagggcagcatagaactaagatagaggaattgagacagcatttgttgaggtggggatttaccacaccagacaaaaaacatcagaaagaacctccattcctttggatgggttatgaactccatcctgataaatggacagtacagcctatagtgctgccagaaaaagacagctggactgtcaatgacatacagaagttagtgggaaaattgaattgggcaagtcagatttatgcagggattaaagtaaggcaattatgtaaactccttaggggaaccaaagcactaacagaagtagtaccactaacagcagaggcagagctagaactggcagaaaacagggagattctaaaagaaccagtacatggagtgtattatgacccctcaaaagacttaatagcagaaatacagaaacaggggcaaggccaatggacatatcaaatttatcaagagccatataaaaatttgaaaacaggaaagtatgcaaggatgaggggtgcccacactaatgatgtaaaacaactaacagaggcagtgcaaaaaataaccacagaaagcatagtaatatggggaaagattcctaaatttaaactacccatacaaaaagaaacgtgggaagcatggtggatagagtattggcaagccacctggattcctgagtgggagtttgtcaatacccctcccttagtgaaattatggtaccagttagagaaagaacccatagtaggagcagaaactttctatgtagatggggcagctaatagggaaactaaattaggaaaagcaggatatgtgactgacagaggaagacaaaaagttgtccccctaacggacacaacaaatcagaaaactgagttacaagcaattcatctagctttgcaggattcgggattagaagtaaacatagtaacagactcacaatatgcattaggaatcattcaagcacaaccagataagagtgaattagaaatagtcaatcaaataatagagcagttaataaaaaaggaaaagatctacctggcatgggtaccagcacacaaaggaattggaggaaatgaacaagtagacaaattagtcagttctggaatcaggaaagtactatttttagatggaatagataaggcccaagaagaacatgagaaatatcacaataattggagagcaatggctagtgactttaacataccacctgtagtagcaaaagaaatagtagccagctgtgataaatgtcagctaaaaggagaagccatgcatggacaagtagactgtagtccaggaatatggcagctagattgtacacacttagaaggaaaagttatcctggtagcagtgcatgtagccggtggatatatagaagcagaagttattccagcagagacagggcaagaaacagcatactttctcttaaaattagcaggaagatggccagtaaaaacaatacacacagacaatggcagcaatttcaccagtactacagtcaaggccgcctgttggtgggcggggatcaagcaggaatttggcattccctacaatccccaaagtcaaggagtaatagaatctatgaataaagaattaaagaaaattataggacaggtaagggatcaggctgaacatcttaagacagcagtacaaacggcagtattcatccacaattttaaaagaaaaggggggattggggggtacagtgcaggggaaagaatagtagacataatagcaacagacatacagactaaagaattacaaaaacaaattacaaaaattcaaaattttcgggtttattacagagacagcagagatccactttggaaaggaccagcaaagcttctctggaaaggtgaaggggcagtagtaatacaagataatagtgacataaaagtagtgccaagaagaaaagtaaagatcattagggattatggaaaacagatggcaggtggtgattgtgtggcaggtagacaggatgaggattaa

SEQ ID NO: 58 - DNA, 579 bp, Human immunodeficiency virus type 1
  isolate=93BR029; gene=vif
atggaaaacagatggcaggtggtgattgtgtggcaggtagacaggatgaggattaacacatggaaaagtttagtaaaataccatatgcatgtttcaaagaaagccaaaagatggttttatagacatcactttgaaagcaggcatccaagagtaagttcagaagtacatatcccactagaggaagctaaattagtaataacaacatattgggggctgcatacaggagaaagagattggcatctgggtcagggagtctccatagaatggaggcaggggaggtataggacacaaatagaccctggcctggcagaccaactgatccatatatattattttgattgtttttcagaatctgccataaggaaagccatattaggacatagaattagccctaggtgtgattatcaagcaggacataacaaggtaggatctctacagtacttggcactaacagcattaataaaaccaaaaaagagaaagccacctttgcccagtgttaagaaactgacagaggatagatggaacaagccccagaagaccaaggaccacagagggagccatacaatgaatggacactag

SEQ ID NO: 59 - DNA, 291 bp, Human immunodeficiency virus type 1
  isolate=93BR029; gene=vpr
atggaacaagccccagaagaccaaggaccacagagggagccatacaatgaatggacactagaacttttagaggaacttaagagtgaagctgttagacattttcctaggttatggctccatagcttaggacaacatatctatgaaacttatggggatacttgggcaggagtggaagccataataagaattctgcaacaactgctgtttattcatttcagaattggatgtcaacatagcagaataggcattaatcgacagaggagagcaaggaatggagccagtagatcctag

SEQ ID NO: 60 - DNA, 2601 bp, Human immunodeficiency virus type 1
  isolate=93BR029; gene=tat
atggagccagtagatcctagactagagccctggaagcatccaggaagtcggcctcagacggcttgtaatagttgctattgtaaaaagtgttgctttcattgtcaagtttgtttcacaacaaagggcttaggcatctcctatggcaggaagaagcggagacagcgacacagaactcctcaaagcagtcagctacatcaagatcctgtaccaaagcagtaagtattgttaagtaatatatgtaatgtcatatttgttagtaataggtttagcagcattaatagcagcactaataatagcaatagttgtgtggactatagcatatatagaatatagggaactagtaaggcaaagaaaaataaataggttatataaaagaataagagaaagagcagaagacagtggcaatgagagtgagggggatgcagaggaattggcagcacttggggaaatggggccttttattcctggggatattgataatctgtaatgctgaaaacttgtgggtcacagtctattatggggtacctgtgtggaaagaagcaaccactactttattctgtgcatcagatgctaaagcatatgaaaaagaagcacataatgtctgggctacacatgcctgtgtacccacagatcccaatccacaagaagtagttctggaaaatgtaacagaaaattttgatatgtggaaaaataacatggtagaacaaatgcatacagatataatcagtttatgggatcaaagcctgaagccatgtgtgaagttaaccccactctgtgttactttacgttgtagtaatgccactaccaacagtactcaaaacgacaccctgaaggaagagccaggggcaatacaaaactgttctttcaatatgaccacagaagtaagagataagcagctgaaagtacatgcacttttttataggcttgatatagtaccaatcagcaatgataatagtagcaatgataatagtagcagagaatacaggctaataaattgtaatacctcaacccttacacaggcttgtccaaaggtatcttgggatccaattcccatacattattgtgctccagctgggtatgcgattctaaagtgtaatgataaaaaattcaatgggacggggccatgcaggaatgtcagcacagtacaatgtacacatggaattaaaccagtggtatcaactcaattgttgttaaatggcagcctagcagaaaaagatataataatcagatctcaaaatatctcagataatgcaaaaaccataatagtacaacttaatgtatctgtgccgattaattgtacaagacccaacaacaatacaagaaaaagtataccaataggaccaggacgagcattttatacaacaggagaaataataggagacatcagaaaggcacattgtaacgttagtggaacaaaatggaatgagacgttagaaaaggtaagggcaaagttaaagcctcatttccctaatgcaacaataaaatttaactcatcctcaggaggggacctagaaattacaatgcatagttttaattgtagaggagaatttttctactgcaatacatcaggactgtttaatgacacagtagacaatggcactatcactctcccatgtcgaataaagcaaattgtaaatatgtggcaggaagtggggcgagcaatgtatgccgctcccattgcaggaaacattacctgtagctcaaatattacaggtctactattgacaagagatggtggtcagaataatcagacggaggagaccttcagacctgggggaggaaatatgaaagacaactggagaagtgaattatataaatataaagtagtagaaattgagccattaggagtagcacccaccaaggcaaaaagacaagtggtgaagagagaaaaaagagcagtgggaatgggagctttgttccttgggttcttgggagcagcaggaagcactatgggcgcagcgtcaataacgctgacggcacaggccagacaattattgtctggcatagtgcaacagcagaataatttgctgagggctattgaagcgcaacagcatctgttgcagctcacagtctggggcattaaacagctccaggcaagaatcctggctgtggaaagatacctaaaggatcaacagctcctagggctttggggctgctctggaaaactcatctgcaccactgatgtgccctggaactctagttggagtaacaaatctcaggagaagatctgggggaacatgacctggatggagtgggaaaaagagattagcaattactcaaacgaaatatataggttaattgaagagtcgcagaaccagcaggaaaagaatgaacaagaattattggcattggacaaatgggcaagtctgtggaattggtttgacatatcaaaatggctgtggtatataaaaatattcataatgatagtaggaggcttgataggcttaagaatagtttttgctgtgctttctatagtaaatagagttaggaagggatactcacctttgtcattacagacccgcttcccaagcccaagggaacccgacaggcccgaaggaatcgaagaaggaggtggagagccaggcaaagacagatccgtga

SEQ ID NO: 61 - DNA, 2652 bp, Human immunodeficiency virus type 1
  isolate=93BR029; gene=rev
atggcaggaagaagcggagacagcgacacagaactcctcaaagcagtcagctacatcaagatcctgtaccaaagcagtaagtattgttaagtaatatatgtaatgtcatatttgttagtaataggtttagcagcattaatagcagcactaataatagcaatagttgtgtggactatagcatatatagaatatagggaactagtaaggcaaagaaaaataaataggttatataaaagaataagagaaagagcagaagacagtggcaatgagagtgagggggatgcagaggaattggcagcacttggggaaatggggccttttattcctggggatattgataatctgtaatgctgaaaacttgtgggtcacagtctattatggggtacctgtgtggaaagaagcaaccactactttattctgtgcatcagatgctaaagcatatgaaaaagaagcacataatgtctgggctacacatgcctgtgtacccacagatcccaatccacaagaagtagttctggaaaatgtaacagaaaattttgatatgtggaaaaataacatggtagaacaaatgcatacagatataatcagtttatgggatcaaagcctgaagccatgtgtgaagttaaccccactctgtgttactttacgttgtagtaatgccactaccaacagtactcaaaacgacaccctgaaggaagagccaggggcaatacaaaactgttctttcaatatgaccacagaagtaagagataagcagctgaaagtacatgcacttttttataggcttgatatagtaccaatcagcaatgataatagtagcaatgataatagtagcagagaatacaggctaataaattgtaatacctcaacccttacacaggcttgtccaaaggtatcttgggatccaattcccatacattattgtgctccagctgggtatgcgattctaaagtgtaatgataaaaaattcaatgggacggggccatgcaggaatgtcagcacagtacaatgtacacatggaattaaaccagtggtatcaactcaattgttgttaaatggcagcctagcagaaaaagatataataatcagatctcaaaatatctcagataatgcaaaaaccataatagtacaacttaatgtatctgtgccgattaattgtacaagacccaacaacaatacaagaaaaagtataccaataggaccaggacgagcattttatacaacaggagaaataataggagacatcagaaaggcacattgtaacgttagtggaacaaaatggaatgagacgttagaaaaggtaagggcaaagttaaagcctcatttccctaatgcaacaataaaatttaactcatcctcaggaggggacctagaaattacaatgcatagttttaattgtagaggagaatttttctactgcaatacatcaggactgtttaatgacacagtagacaatggcactatcactctcccatgtcgaataaagcaaattgtaaatatgtggcaggaagtggggcgagcaatgtatgccgctcccattgcaggaaacattacctgtagctcaaatattacaggtctactattgacaagagatggtggtcagaataatcagacggaggagaccttcagacctgggggaggaaatatgaaagacaactggagaagtgaattatataaatataaagtagtagaaattgagccattaggagtagcacccaccaaggcaaaaagacaagtggtgaagagagaaaaaagagcagtgggaatgggagctttgttccttgggttcttgggagcagcaggaagcactatgggcgcagcgtcaataacgctgacggcacaggccagacaattattgtctggcatagtgcaacagcagaataatttgctgagggctattgaagcgcaacagcatctgttgcagctcacagtctggggcattaaacagctccaggcaagaatcctggctgtggaaagatacctaaaggatcaacagctcctagggctttggggctgctctggaaaactcatctgcaccactgatgtgccctggaactctagttggagtaacaaatctcaggagaagatctgggggaacatgacctggatggagtgggaaaaagagattagcaattactcaaacgaaatatataggttaattgaagagtcgcagaaccagcaggaaaagaatgaacaagaattattggcattggacaaatgggcaagtctgtggaattggtttgacatatcaaaatggctgtggtatataaaaatattcataatgatagtaggaggcttgataggcttaagaatagtttttgctgtgctttctatagtaaatagagttaggaagggatactcacctttgtcattacagacccgcttcccaagcccaagggaacccgacaggcccgaaggaatcgaagaaggaggtggagagccaggcaaagacagatccgtgagattagtgaacggattcttagctcttgtctgggacgacctgaggaacctgtgcctcttcagctaccgccacttgagagacttcatattaattgcagcgaggattgtggacaggggactgaagagggggtgggaagccctcaaacttctggggaatctcgcgctgtattggagtcaggaactaaagaatag

SEQ ID NO: 62 - DNA, 2529 bp, Human immunodeficiency virus type 1
  isolate=93BR029; gene=env
atgagagtgagggggatgcagaggaattggcagcacttggggaaatggggccttttattcctggggatattgataatctgtaatgctgaaaacttgtgggtcacagtctattatggggtacctgtgtggaaagaagcaaccactactttattctgtgcatcagatgctaaagcatatgaaaaagaagcacataatgtctgggctacacatgcctgtgtacccacagatcccaatccacaagaagtagttctggaaaatgtaacagaaaattttgatatgtggaaaaataacatggtagaacaaatgcatacagatataatcagtttatgggatcaaagcctgaagccatgtgtgaagttaaccccactctgtgttactttacgttgtagtaatgccactaccaacagtactcaaaacgacaccctgaaggaagagccaggggcaatacaaaactgttctttcaatatgaccacagaagtaagagataagcagctgaaagtacatgcacttttttataggcttgatatagtaccaatcagcaatgataatagtagcaatgataatagtagcagagaatacaggctaataaattgtaatacctcaacccttacacaggcttgtccaaaggtatcttgggatccaattcccatacattattgtgctccagctgggtatgcgattctaaagtgtaatgataaaaaattcaatgggacggggccatgcaggaatgtcagcacagtacaatgtacacatggaattaaaccagtggtatcaactcaattgttgttaaatggcagcctagcagaaaaagatataataatcagatctcaaaatatctcagataatgcaaaaaccataatagtacaacttaatgtatctgtgccgattaattgtacaagacccaacaacaatacaagaaaaagtataccaataggaccaggacgagcattttatacaacaggagaaataataggagacatcagaaaggcacattgtaacgttagtggaacaaaatggaatgagacgttagaaaaggtaagggcaaagttaaagcctcatttccctaatgcaacaataaaatttaactcatcctcaggaggggacctagaaattacaatgcatagttttaattgtagaggagaatttttctactgcaatacatcaggactgtttaatgacacagtagacaatggcactatcactctcccatgtcgaataaagcaaattgtaaatatgtggcaggaagtggggcgagcaatgtatgccgctcccattgcaggaaacattacctgtagctcaaatattacaggtctactattgacaagagatggtggtcagaataatcagacggaggagaccttcagacctgggggaggaaatatgaaagacaactggagaagtgaattatataaatataaagtagtagaaattgagccattaggagtagcacccaccaaggcaaaaagacaagtggtgaagagagaaaaaagagcagtgggaatgggagctttgttccttgggttcttgggagcagcaggaagcactatgggcgcagcgtcaataacgctgacggcacaggccagacaattattgtctggcatagtgcaacagcagaataatttgctgagggctattgaagcgcaacagcatctgttgcagctcacagtctggggcattaaacagctccaggcaagaatcctggctgtggaaagatacctaaaggatcaacagctcctagggctttggggctgctctggaaaactcatctgcaccactgatgtgccctggaactctagttggagtaacaaatctcaggagaagatctgggggaacatgacctggatggagtgggaaaaagagattagcaattactcaaacgaaatatataggttaattgaagagtcgcagaaccagcaggaaaagaatgaacaagaattattggcattggacaaatgggcaagtctgtggaattggtttgacatatcaaaatggctgtggtatataaaaatattcataatgatagtaggaggcttgataggcttaagaatagtttttgctgtgctttctatagtaaatagagttaggaagggatactcacctttgtcattacagacccgcttcccaagcccaagggaacccgacaggcccgaaggaatcgaagaaggaggtggagagccaggcaaagacagatccgtgagattagtgaacggattcttagctcttgtctgggacgacctgaggaacctgtgcctcttcagctaccgccacttgagagacttcatattaattgcagcgaggattgtggacaggggactgaagagggggtgggaagccctcaaacttctggggaatctcgcgctgtattggagtcaggaactaaagaatagtgctattagcttgcttaataccacagcaatagtagtagctgaggggacagatagagttatagaagctttgcaaagagcgggtagagctgttcttaacgtacctagaagaataagacagggcttggaaagggctttgctataa

SEQ ID NO: 63 - DNA, 621 bp, Human immunodeficiency virus type 1
  isolate=93BR029; gene=nef
atgggtagcaagtggtcaaaaagtagtatagttgggtggcctgctataagggaaagattaagacaaacccctccagcagcagaaggggtgggagcagtgtctcaagacttagaaagacggggggcaattacaagcagcaatactggagctaataatcctgacttggcctggctggaggcacaagaggaagaggaagtaggctttccagtcagacctcaggtacctttaagaccaatgacttataagggagctcttgatctcagtcactttttaaaagaaaaggggggactggaagggttaatttattccaagaaaagacaagagatccttgatctgtgggtttaccacacacaaggctacttccctgattggcagaactacacaccagggccagggaccagatatccactgaccttagggtggtgcttcaagctagtaccagttgacccagaggaggtagaaaaggccaatgaaggagagaacaactgcttgctacaccccatgagccaacatggaatggaggatgaagacagagaaatactgcagtggaggtttgacagccgcctagcatttcatcacatggcccgagagctgcatccggagtactacaaggactgctga

SEQ ID NO: 64 - DNA, 1503 bp, Human immunodeficiency virus type 1
  isolate=94CY032.3; gene=gag
atgggtgcgagagcgtcagtattaagtgggggaaaattagatgcatgggagaggattcggttaaggccagggggaaagaaaaaatatagactgaaacatctagtatgggcaagcagagagttggaaagattcgcacttaaccctggccttttagaaacagcagaaggatgtcaacaattaatggaacagttacaatcaactctcaaaacaggatcagaagaacttagatcattatataatactataacaaccctctggtgcgtacatcaaagaatagatgtacaagacaccaaggaagctttagataaaatagaggaaatacaaagtaagagcaagcaaaagacacagcaggcagcagctgccgcaggaggtagcagcaatgtcagccaaaattaccctatagtgcaaaatgcacaagggcaaatggtacatcagagcatttcacctagaactttgaatgcatgggtaaaagtaatagaagaaaaggctttcagcccagaagtaatacccatgttctcagcattatcagagggagccaccccacaagatttgaacatgatgctaaatatagtggggggacaccaggcagcaatgcaaatgttaaaagataccatcaatgaggaagctgcagactgggacaggacacatccagtacatgcagggcctattccaccaggccagatgagagaaccaaggggaagtgatatagcaggaactactagtacccttcaagaacaaataggatggatgacaagcaacccacctgtcccagtgggagaaatctataaaagatggataatcttggggttaaataaaatagtaagaacgtatagccccattagcatcttggacataagacaaggaccaaaagaacccttcagagattatgtagataggttctttaaatgtctcagagcagaacaagctacccaggaggtgaaaaattggatgacagaaaccctgctggtccaaaatgcgaatccagactgtaagtccatcttaaaagcattaggaacaggggctacattagaagaaatgatgacagcatgtcagggagtgggaggacccagccataaagcaagagttttagctgaggcaatgagccaggcatcaaatgcagcagcagccataatgatgcagaaaagcaaatttaagggccaaagaagaactattaagtgtttcaactgtggcaaggaaggacatctagccagaaattgcagggcccctaggaaaaagggctgctggaagtgtggaaaggagggacatcaaatgaaagactgcactgagagacaggctaattttttagggagaatgtggccttccagcaaagggaggccaggaaattttcttcagaacaggccagagccaacagccccgcccgcggaatgcttagagaggaaagaggagacaacctcctctctgaagcaggaaccgagggacaaggaactatatcctttaacttccctcaaatcactctttggcagcgaccccttgtcacaataa

SEQ ID NO: 65 - DNA, 3009 bp, Human immunodeficiency virus type 1
  isolate=94CT032.3; gene=pol
ttttttagggagaatgtggccttccagcaaagggaggccaggaaattttcttcagaacaggccagagccaacagccccgcccgcggaatgcttagagaggaaagaggagacaacctcctctctgaagcaggaaccgagggacaaggaactatatcctttaacttccctcaaatcactctttggcagcgaccccttgtcacaataaaactagggggacagataagggaggctcttttagatacaggagcagatgatacagtattagaagaaataaatttgccaggaaaatggaagccaaaaatgatagggggaatcggaggttttatcaaagtaagacaatatgatcagatacctatagaaatttgtggaaaaaaggccataggcacagtgttagtaggacctacacctgtcaacataattggacgaaacatgttgactcagcttggttgtactttaaattttccaattagtcctattgaaactgtaccagtaaaattaaagccaggaatggatggcccaaaggttaaacaatggccattgacagaagaaaaaataaaagccttaacagagatatgtacagacatggaaaaggaaggcaagatttcaaaaattgggcctgaaaatccatacaatactccaatatttgctataaagaaaaaagacagcactaaatggagaaaattagtagatttcagagaactcaataaaagaactcaggacttctgggaagttcagttaggaataccgcacccagcagggttaaagaagaaaaaatcagtaacagtattggatgtgggggatgcatatttttcagttcccttagatccagagttcaggaagtacactgcattcaccatacctagtaccaacaatgagacaccaggaattagatatcagtacaatgtgcttccacagggctggaaaggatcaccagcaatattccaatgtagcatgacaaaaatcttagagccctttagattcaaaaacccagaaatagtcatataccaatatatggatgatttgtatgtagggtctgacttagaaatagggcaacatagagcaaaaatagaagagctaagagagcatctattgagatggggattcaccacaccagacaaaaaacatcagaaagaacccccatttctttggatggggtatgaactccatcctgacaaatggacagtgcagcctatacaaccggcagaaaaggatagctggactgtcaacgatatccagaagttagtgggaaaactaaattgggcaagtcagatttatccagggattaaagtaaagcaattatgtaaacttcttaggggagctaaagccctaacagacatagtaccactaactacagaggcagagttagaattagcagagaacagggagattctaaaagaaccagtacatggggcatattatgacccatcaaaagacttaatagcagaaatacagaagcaagggcaaggtcaatggacatatcaaatatatcaagagccacataaaaatctgaaaacagggaagtatgcaagaaccagatctgcccacactaatgatgttagacaattaacagaagcagtgcaaaagatagccatggaatgcatagtaatatggggaaagactcctaagtttagattacccatacaaaaggaaacatgggacacatggtggacagaatattggcaggccacctggatccctgaatgggaatttgtcaatacccctcctctagtaaaattatggtaccagttagaaacagaccccatagcaggagcagaaactttctatgtagatggggcagctaatagagaaacaaaacagggaaaagcaggatatgttactgatagaggcagacaaaaagttgtctccctatctgaaacaacaaatcagaagactgaattacaagcaatttacttagctttgcaggattcaggatcagaagtaaacatagtaacagactcacagtatgcaataggaatcattcaagcacaaccagatagaagtgaatcagatttagttaatcaaataatagagcagttaatacggaaggacaaggtctacctgtcatgggtaccagcacacaaagggattggaggaaatgaacaagtagataaattagtcagcaatggaatcagaaaggtgctatttttagatggaatagataaggctcaagaagaacatgagaaatatcacaataactggagagcaatggctagtgattttaatctgccatcagtggtagcaaaagagatagtagctagctgtaataaatgtcagctaaaaggggaagccatgcatggacaagtggactgtagtccagggatatggcagttagattgtacacatttagaaggtaaagttatcatggtagcagttcatgtggctagtggatacatagaagcagaagttatcccagcagaaacaggacaggaaacagcctacttcatactaaaattagcaggaagatggccagtgaaaatgatacatgcagacaacggccccaatttcaccagtgctgcggttaaggcagcctgttggtgggcagatatcaaccaggaatttggaattccctacaatccccaaagccaaggagtagtggaatctatgaataaagaattaaagaaaatcatagggcaggtcagggatcaagctgaacaccttaagacagcagtacagatggcagtattcattcacaattttaaaagaaaaggggggattggggggtacagtgcaggggaaagaataatagacataatagcatcagatatacaaactaaagaactacaaaaacaaattacaaaaattcaaaattttcgggtttattacagggacagcagagaaccaatttggaagggaccagcaaaactactctggaaaggtgaaggggcagtagtaatacaggacaacagtgatatcaaagtagtaccaagaagaaaagcaaagattattagggactatggcaaacagatggcaggtaatgattgtgtggcaggtagacaggatgaagattag

SEQ ID NO: 66 - DNA, 579 bp, Human immunodeficiency virus type 1
  isolate=94CT032.3; gene=vif
atggcaaacagatggcaggtaatgattgtgtggcaggtagacaggatgaagattagaacatggaacagtctagtgaaacatcatatgtatgtttcaaagaaagctaaaggatgattctatagacatcactatgaaagtaggcacccaaaagtaagttcagaagtacatatcccactaggggaggctagattagtagtaagaacatattggggtctgcagccaggggaacaagactggcacttgggtcatggagtctccatagaatggaggctcagaagatatagcacacaagtggatcctgacctggcagaccaactaattcatatgcattactttgattgtttttcagaatctgccataaggaaagccatattaggacatagagttagtcctaggtgtgaatatcaagcaggacataataaggtaggatccttacaatacctggcactagcagcattaatatccccaaaaaagacaaagccacctttgcctagtgttaagaaactagtggaggatagatggaacaagccccagaagaccaggggccgcagagagaaccaaataatgaatggacactag

SEQ ID NO: 67 - DNA, 288 bp, Human immunodeficiency virus type 1
  isolate=94CY032.3; gene=vpr
atggaacaagccccagaagaccaggggccgcagagagaaccaaataatgaatggacactagagcttttggaggagcttaaaaatgaagctgttaggcattttcctagaccctggctccatggcctaggacagcatatctataacacttatggagatacctgggaaggggttgaagctataataagaattttgcaacaactactgtttattcatttcagaattgggtgccaacatagtagaataggcattactcctcaaaggagaagaggcaggggatggagccagtag

SEQ ID NO: 68 - DNA, 2643 bp, Human immunodeficiency virus type 1
  isolate=94CT032.3; gene=tat
atggagccagtagatcctgacctagagccctggaaccatccgggaagtcagcctacaactgattgtaacaagtgtttctgtaaaaagtgttgctggcattgccaagtttgctttctgaaaaaaggcttaggcatctcctatggcaggaagaagcggaaacatcgacgaggatctcttcaaggcagcaagggccatcaaaatcttataccaaagcagtaagtattaagtatatgtaatgttattctgggaaatctgggcaatagtaggactggtagtagcgctaattatagtaatagtagtgtggactttagtatttatagaatataagaaattgagaaggcaaaggagaatagacagcttgtacaatagaataagagaaagagcagaagacagtggcaatgagagtgatggggatgcagaggaattatccacacttgtgggaatggggaactttgatccttgggttggtgataatctgtagtgcctcaaacaacttgtgggtcacagtttattatggggtacctgtgtggagagacgcagagaccaccctattttgtgcatcagaagctaaagcatatgagaaagaagtacataatatctgggctacacatgcctgtgtacccacagaccccaacccacaagaagtagctctgataaatgtaacagagaactttaacatgtggaaaaatgacatggtagaacagatgcatgaggatataatcagtttatggaatgaaggcctaaaaccatgtgcaaagctaacctctctctgtgttacttttacatgtattaatgcaactactactaatagtaccaatggcactgtgattaaagaaggaataaaaaactgctctttcgatataaccacagaaataagggataagaagaagaaagaatatgcgcttttctatagaattgatatagtgccaattaatgctagagtgccaattaatggtagtaataggaataatagtacagaagagtatatgttaataaattgtaacgcctcaaccattaaacaggcttgcccaaaggtgtcttttgagccaattcccatacattattgtgccccagctggttttgcaattttaaagtgtaatgagaaaaatttcactggattagggccatgcacaaatgtcagctcggtacgatgcactcatggaattaagccagtggtatcaactcaattgctgttaaatggaagcttagcaacggaagaggtagtaattagatctaaaaatatcacagacaataccaaaaatataatagtacagcttgcaaaggctgtaaaaattaattgtaccagacctggcaacaatacaagaaaaagtgtacatatagggccaggactaacatggtatgcaacaggtgaaataataggagatataagacaagcacattgtaacattagtggaaatgattggaatgacaccttaaaagtgataagtgaagaattgaaaagactcttccctaataaaacaataaaatttgctccacccgtaggaggggacctagaaattacaacacatagctttaattgtaaaggagaatttttctattgcaatacaacaccactgtttaatagtacacacatgcaaaatggtacaaacattacaagtacagattctacaaattcaaccatcacactccaatgcagactaaaacaatttgtaaggatgtggcaggaagtggggcaagcaatgtacgcctcccccattgcagggagcattaactgcagctcagatattacaggaataatattgacaagagatggtggtactaataatactgagatcttcagacctggaggaggagacatgagggacaattggagaagtgaactatataaatataaagtagtaaagattgaaccaataggagtagcacccaataaggcaaggagacgagtggtgcagagagaaaaatgagcagtgggaataggggccatgttccttgggttcttgggagcagcaggaagcactatgggcgcagcgtcaatgacgctgacggtacaggccagacaattattgtccggcatagtgcagcagcagagcaatttgctgagggctatagaggctcaacaacatctgttgagactcacggtctggggcattaaacagctccaggcaagagtcctggctctggaaagctacctaaaggatcaacagctcctaggaatttggggctgctctggaaaactcatctgcaccactaatgtaccttggaactctagttggagtaataaatcttataatgatatatgggacaatatgacctggttgcaatgggataaagaaattaacaattacacacaaataatatatgggttacttgaagaatcacagaaccagcaggaaaagaatgagcaagacttattggccttggacaagtgggcaagcctgtggaattggtttagcataacaaaatggctatggtatataaaaatatttataatgatagtaggaggcttgataggcttaagaataatttttgctgtgctttctatagtaaatagagttaggcagggatactcacctttgtctttgcagacccttatcccaacaacccaacggggactcgacaggcccggaggaacagaagaagaaggtggcgagcaagacagaagcagatccattcgcttag

SEQ ID NO: 69 - DNA, 2688 bp, Human immunodeficiency virus type 1
  isolate=94CT032.3; gene=rev
atggcaggaagaagcggaaacatcgacgaggatctcttcaaggcagcaagggccatcaaaatcttataccaaagcagtaagtattaagtatatgtaatgttattctgggaaatctgggcaatagtaggactggtagtagcgctaattatagtaatagtagtgtggactttagtatttatagaatataagaaattgagaaggcaaaggagaatagacagcttgtacaatagaataagagaaagagcagaagacagtggcaatgagagtgatggggatgcagaggaattatccacacttgtgggaatggggaactttgatccttgggttggtgataatctgtagtgcctcaaacaacttgtgggtcacagtttattatggggtacctgtgtggagagacgcagagaccaccctattttgtgcatcagaagctaaagcatatgagaaagaagtacataatatctgggctacacatgcctgtgtacccacagaccccaacccacaagaagtagctctgataaatgtaacagagaactttaacatgtggaaaaatgacatggtagaacagatgcatgaggatataatcagtttatggaatgaaggcctaaaaccatgtgcaaagctaacctctctctgtgttacttttacatgtattaatgcaactactactaatagtaccaatggcactgtgattaaagaaggaataaaaaactgctctttcgatataaccacagaaataagggataagaagaagaaagaatatgcgcttttctatagaattgatatagtgccaattaatgctagagtgccaattaatggtagtaataggaataatagtacagaagagtatatgttaataaattgtaacgcctcaaccattaaacaggcttgcccaaaggtgtcttttgagccaattcccatacattattgtgccccagctggttttgcaattttaaagtgtaatgagaaaaatttcactggattagggccatgcacaaatgtcagctcggtacgatgcactcatggaattaagccagtggtatcaactcaattgctgttaaatggaagcttagcaacggaagaggtagtaattagatctaaaaatatcacagacaataccaaaaatataatagtacagcttgcaaaggctgtaaaaattaattgtaccagacctggcaacaatacaagaaaaagtgtacatatagggccaggactaacatggtatgcaacaggtgaaataataggagatataagacaagcacattgtaacattagtggaaatgattggaatgacaccttaaaagtgataagtgaagaattgaaaagactcttccctaataaaacaataaaatttgctccacccgtaggaggggacctagaaattacaacacatagctttaattgtaaaggagaatttttctattgcaatacaacaccactgtttaatagtacacacatgcaaaatggtacaaacattacaagtacagattctacaaattcaaccatcacactccaatgcagactaaaacaatttgtaaggatgtggcaggaagtggggcaagcaatgtacgcctcccccattgcagggagcattaactgcagctcagatattacaggaataatattgacaagagatggtggtactaataatactgagatcttcagacctggaggaggagacatgagggacaattggagaagtgaactatataaatataaagtagtaaagattgaaccaataggagtagcacccaataaggcaaggagacgagtggtgcagagagaaaaatgagcagtgggaataggggccatgttccttgggttcttgggagcagcaggaagcactatgggcgcagcgtcaatgacgctgacggtacaggccagacaattattgtccggcatagtgcagcagcagagcaatttgctgagggctatagaggctcaacaacatctgttgagactcacggtctggggcattaaacagctccaggcaagagtcctggctctggaaagctacctaaaggatcaacagctcctaggaatttggggctgctctggaaaactcatctgcaccactaatgtaccttggaactctagttggagtaataaatcttataatgatatatgggacaatatgacctggttgcaatgggataaagaaattaacaattacacacaaataatatatgggttacttgaagaatcacagaaccagcaggaaaagaatgagcaagacttattggccttggacaagtgggcaagcctgtggaattggtttagcataacaaaatggctatggtatataaaaatatttataatgatagtaggaggcttgataggcttaagaataatttttgctgtgctttctatagtaaatagagttaggcagggatactcacctttgtctttgcagacccttatcccaacaacccaacggggactcgacaggcccggaggaacagaagaagaaggtggcgagcaagacagaagcagatccattcgcttagtgaacggattcttgccacttatctgggacgacctgcggaacctgtgcctcttcagctaccgccacttgagaaacttactcttaattgtagcgaggactgtggaacttctggggataagggggtgggaagccctcaagtatctgtggaacttcctgctgtattggggacaggagctaaagaatag

SEQ ID NO: 70 - DNA, 246 bp, Human immunodeficiency virus type 1
  isolate=94CT032.3; gene=vpu
atgttattctgggaaatctgggcaatagtaggactggtagtagcgctaattatagtaatagtagtgtggactttagtatttatagaatataagaaattgagaaggcaaaggagaatagacagcttgtacaatagaataagagaaagagcagaagacagtggcaatgagagtgatggggatgcagaggaattatccacacttgtgggaatggggaactttgatccttgggttggtgataatctgtag

SEQ ID NO: 71 - DNA, 2571 bp, Human immunodeficiency virus type 1
  isolate=94CY032.3; gene=env
atgagagtgatggggatgcagaggaattatccacacttgtgggaatggggaactttgatccttgggttggtgataatctgtagtgcctcaaacaacttgtgggtcacagtttattatggggtacctgtgtggagagacgcagagaccaccctattttgtgcatcagaagctaaagcatatgagaaagaagtacataatatctgggctacacatgcctgtgtacccacagaccccaacccacaagaagtagctctgataaatgtaacagagaactttaacatgtggaaaaatgacatggtagaacagatgcatgaggatataatcagtttatggaatgaaggcctaaaaccatgtgcaaagctaacctctctctgtgttacttttacatgtattaatgcaactactactaatagtaccaatggcactgtgattaaagaaggaataaaaaactgctctttcgatataaccacagaaataagggataagaagaagaaagaatatgcgcttttctatagaattgatatagtgccaattaatgctagagtgccaattaatggtagtaataggaataatagtacagaagagtatatgttaataaattgtaacgcctcaaccattaaacaggcttgcccaaaggtgtcttttgagccaattcccatacattattgtgccccagctggttttgcaattttaaagtgtaatgagaaaaatttcactggattagggccatgcacaaatgtcagctcggtacgatgcactcatggaattaagccagtggtatcaactcaattgctgttaaatggaagcttagcaacggaagaggtagtaattagatctaaaaatatcacagacaataccaaaaatataatagtacagcttgcaaaggctgtaaaaattaattgtaccagacctggcaacaatacaagaaaaagtgtacatatagggccaggactaacatggtatgcaacaggtgaaataataggagatataagacaagcacattgtaacattagtggaaatgattggaatgacaccttaaaagtgataagtgaagaattgaaaagactcttccctaataaaacaataaaatttgctccacccgtaggaggggacctagaaattacaacacatagctttaattgtaaaggagaatttttctattgcaatacaacaccactgtttaatagtacacacatgcaaaatggtacaaacattacaagtacagattctacaaattcaaccatcacactccaatgcagactaaaacaatttgtaaggatgtggcaggaagtggggcaagcaatgtacgcctcccccattgcagggagcattaactgcagctcagatattacaggaataatattgacaagagatggtggtactaataatactgagatcttcagacctggaggaggagacatgagggacaattggagaagtgaactatataaatataaagtagtaaagattgaaccaataggagtagcacccaataaggcaaggagacgagtggtgcagagagaaaaatgagcagtgggaataggggccatgttccttgggttcttgggagcagcaggaagcactatgggcgcagcgtcaatgacgctgacggtacaggccagacaattattgtccggcatagtgcagcagcagagcaatttgctgagggctatagaggctcaacaacatctgttgagactcacggtctggggcattaaacagctccaggcaagagtcctggctctggaaagctacctaaaggatcaacagctcctaggaatttggggctgctctggaaaactcatctgcaccactaatgtaccttggaactctagttggagtaataaatcttataatgatatatgggacaatatgacctggttgcaatgggataaagaaattaacaattacacacaaataatatatgggttacttgaagaatcacagaaccagcaggaaaagaatgagcaagacttattggccttggacaagtgggcaagcctgtggaattggtttagcataacaaaatggctatggtatataaaaatatttataatgatagtaggaggcttgataggcttaagaataatttttgctgtgctttctatagtaaatagagttaggcagggatactcacctttgtctttgcagacccttatcccaacaacccaacggggactcgacaggcccggaggaacagaagaagaaggtggcgagcaagacagaagcagatccattcgcttagtgaacggattcttgccacttatctgggacgacctgcggaacctgtgcctcttcagctaccgccacttgagaaacttactcttaattgtagcgaggactgtggaacttctggggataagggggtgggaagccctcaagtatctgtggaacttcctgctgtattggggacaggagctaaagaatagtgctattaatttgtttaataccacagcaatagcagtagctgagggaacagataggattatagaagcagtacagagagcttgtagagctatttgcaacatacctagaagaatcagacagggccttgaaagagctttgctttaa

SEQ ID NO: 72 - DNA, 660 bp, Human immunodeficiency virus type 1
  nef
atgggaggcaaatggtcaaaaagtagcatagttggatggcctgagataagggaaagaatgaggcgagctcgagctgagccagaaagaatgaggcgagctcaagctgagccagcagcagcaggagtaggagcagtgtctcaagacttggacaaacatggggcaatcacaattaacaatacagcagctactaatcctgacaaaacctggctggaagcacaagaagaggaagaagaggtaggttttccagtcaggccacaggtacctttaaggccaatgacctttaaaggagctttagatctcagccactttttaaaagaaaaggggggactggatgggctaatttactccaagaaaagacaagagatccttgatctgtgggtctatcacacacaaggtttcttccctgattgggataactacacaccaggaccaggggagagattcccactgtgctttggatggtgcttcaagctagtaccagtagatccacaggaggtggaagaggccactgaaggagagaacacctgtttgctgcaccctataagccagcatggaatggaggatgaagagagagaagtattaaagtggaagtttgacagtcgcctggcatacaagcacgtagcccgagagctgcatccggagttttacaaagactgctga

SEQ ID NO: 73 - DNA, 1485 bp, Human immunodeficiency virus type 1
  isolate=96ZM651.8; gene=gag
atgggtgcgagagcgtcaatattaagagggggaaaattagataaatgggaaaaaattaggctaaggccagggggaaagaaacgctatatgataaaacacctagtatgggcaagcagggagctggaaagatttgcgcttaaccctggccttttagaaacatcagaaggctgtaaacaaataatgaaacagctacaaccagctcttcagacaggaacggaggaacttagatcattatacaacacagtagcaactctctattgtgtacatgaaggggtagaggtacgagacaccaaggaagccttagacaggatagaggaagaacaaaacaaaattcagcaaaaaatacagcaaaaaacacagcaagcggctgacggaaaggtcagtcaaaattatcctatagtgcagaatctccaagggcaaatggtacaccagaaactatcacctagaactttgaatgcatgggtaaaagtaatagaagaaaaagcttttagcccagaggtaatacccatgtttacagcattatcagaaggagccaccccacaagatttaaacaccatgttaaatacagtggggggacatcaagcagccatgcaaatgttaaaagatactatcaatgaggaggctgcagaatgggatagattacatccagtgcatgcagggcctattgcaccaggccaaatgagagaaccaaggggaagtgatatagcaggaactactagtaccctccaagaacagatagcatggatgacaagtaatccccctattccagtgggagacatctataaaagatggataattctggggttaaataaaatagtaagaatgtatagccctgtcagcattttggacataaaacaagggccaaaggaaccctttagagactatgtagaccggttcttcaaaactttaagagctgaacaggctacacaagaagtaaaaaattggatgacagacaccttgttggtccaaaatgcaaacccagattgcaagaccattttaaaagcattaggaccaggggctacattagaagaaatgatgacagcatgtcaaggagtgggaggacctagccacaaagcaagagtgttggctgaggcaatgagccaaacaaatagtgtaaacatactgatgcagaaaagcaattttaaaggaaataaaagaatggttaaatgttttaactgtggtaaggaagggcacatagccagaaattgcagggcccctaggaaaaagggctgttggaaatgtggaaaggagggacaccaaatgaaagactgtactgagaggcaggctaattttttagggaaaatttggccttcccacaagggaaggccagggaatttccttcagaacaggccagagccaacagccccaccagcagagagcttcaggttcgaggagacaacccccgctccgaagcaggagtcgaaagacagggaagccttaacttccctcaaatcactctttggcagcgaccccttgtctcaataa

SEQ ID NO: 74 - DNA, 3000 bp, Human immunodeficiency virus type 1
  isolate=96ZM651.8; gene=pol
ttttttagggaaaatttggccttcccacaagggaaggccagggaatttccttcagaacaggccagagccaacagccccaccagcagagagcttcaggttcgaggagacaacccccgctccgaagcaggagtcgaaagacagggaagccttaacttccctcaaatcactctttggcagcgaccccttgtctcaataaaggtagggggccaaataaaggaggctctcttagacacgggagcaggtgatacagtattagaagaaataaatttgccaggcaaatggaaaccaaaaatgataggaggaattggaggctttatcgaagtaagacaatatgatcaaatacctatggaaatttgtggaaaaaaggctataggtacagtattagtaggacctacacctgtcaacataattggaagaaatatgttgactcagcttggatgcacactaaattttccaattagtcctattgaaactgtaccagtaaaattaaagccaggaatggatggcccaaaggttaaacaatggccattgacagaagagaaaataaaagctttaacagcaatttgtgaagaaatggagaaggaaggaaaaattacaaaaattgggcctgaaaatccatataacactccagtatttgccataaaaaagaaggacagtactaagtggcgaaaattagtagatttcagggaactcaataaaagaactcaagacttttgggaagttcaattaggaataccacacccagcagggttaaaaaagaaaaaatcagtgacagtactggatgtgggggatgcatatttttcagttcctttagatgaaagcttcaggaaatatactgcattcaccatacctagtacaaacaatgaaacaccagggattagatatcaatataatgtgcttccacagggatggaaaggatcaccagcaatattccagagtagcatgacaaaaatcttagagcccttcagggcacaaaatccagacatagtcatctatcaatatatggatgacctgtatgtaggatctgacttagaaatagggcaacatagagcaaaaatagaagagttaagagaacatctattaaagtggggatttaccacaccagacaagaaacatcagaaagaacccccatttctttggatggggtatgaactccatcctgacaaatggacagtacagcctatacagctggcagaaaaagatagctggactgttaatgatatacagaagttagtgggaaaattaaactgggcaagtcagatttacgcagggattaaagtaaggcaactttgtaaactccttaggggagccaaagcactaacagacatagtaccactaactgaagaagcagaattagaattggcagagaacaaggaaattttaaaagaaccagtacatggggtatattatgacccatcaaaagacttgatagctgaaatacagaaacaagggcatgaccaatggacatatcaaatttaccaggaaccattcaaaaatctgaaaacagggaagtatgcaaaaatgaggacagcccacactaatgatgtaaaacagttaacagaggcagtgcaaaaaatagccctggagagcatagtaatatggggaaagattcctaaatttagactacccatccaaaaagaaacatgggaaacatggtggacagactattggcaagccacctggattcctgagtgggagtttgttaatacccctctcttagtaaaattatggtaccagctggagaaagaacccatagtaggagcagaaaccttctatgtagatggagcagccaatagggaaactaaattaggaaaagcagggtatattactgacagaggaaggcaaaaaattgttactctaactgaaacaacaaatcagaagactgaattacaagcaatttacctagctttgcaagattcaggatcagaagtaaacatagtaactgactcacagtatgcgttaggaatcattcaagcacatccagataagagtgaatcagagttagtcaaccaaataatagaacaattaataaagaaggaaagggtctacctgtcatgggtaccagcacataaaggaattggaggtaatgaacaggtagataaattagtaagcaagggaatcaggaaagtgctgtttctagatggaatagacaaggctcaagaagagcatgaaaaatatcacaacaattggagagcaatggctagtgaatttaatctaccaccagtagtagcaaaagaaatagtagctagttgtgataaatgtcagcaaaaaggggaagccacacatggacaagtagactgtagtccagggatatggcaattagactgtacacatttagaaggaaaaatcatcctggtagcagtccatgtagccagtggctacatagaagcagaggttatcccagcagaaacaggacaagaaacagcatactatatattaaaattagcaggaagatggccagtcaaagtaatacatacagacaatggtagcaattttaccagtgctgcagttaaggcagcctgttggtgggcaggtatcaaacaagaatttggaattccctacaatccacaaagtcagggagtagtagaatccatgaataaagaattaaagaaaatcatagggcaggtaagagatcaggctgagcatcttaaaacagcagtacaaatggcagtattcattcacaattttaaaagaaaaagggggattggggggtacagtgcaggggaaagaataatagacataatagcaacagacatacaaaccaaagaactacaaaaacaaattataaacattcaaaaatttcgggtttattacagagacagcagagaccccatttggaaaggaccagccaaactactctggaaaggtgaaggggcagtagtaatacaagataatagtgacataaaagtggtaccaaggaggaaagcaaaaatcattagggactatggaaaacagatggcaggcgctgattgtgtggcaggtagacaggatgaggattag

SEQ ID NO: 75 - DNA, 579 bp, Human immunodeficiency virus type 1
  isolate=96ZM651.8; gene=vif
atggaaaacagatggcaggcgctgattgtgtggcaggtagacaggatgaggattagaacatggaatagtttagtaaagcaccatatgtatatttcacggaaagctaatggatggttttacagacatcattatgaaagcagacatccaagggtaagttcagaagtacatatcccattaggggatgctaaattagtaataaaaacatattggggtttgcaaacaggagaaagagattggcatttgggtcatggagtctccatagaatggagattgagaagatatagcacacaagtagaccctggcctggcagaccagctaattcatatgcactattttgattgttttgcagactctgccataagaaaagccatattaggacacatagttattcctaggtgtgactatcaagcaggacataataaggtaggatctctgcaatacttggcactgacagcattgataaaaccaaaaaagagaaagccacctctgcctagtgttaggaaattagtagaggatagatggaacaattcccagaagaccaagggccgcagagggaaccatacagtgagtggacactag

SEQ ID NO: 76 - DNA, 291 bp, Human immunodeficiency virus type 1
  isolate=96ZM651.8; gene=vpr
atggaacaattcccagaagaccaagggccgcagagggaaccatacagtgagtggacactagagattctagaggaactcaagcaggaagctgtcagacactttcctagaccatggctccatagcttaggacaacatatctatgaaacttatggggatacttggactggagtcgaggctataataagaatactgcaacaactactgtttattcatttcagaattgggtgccagcacagcagaataggcatggttcgacagagaagagcgagaaatggagccagtagatcctag

SEQ ID NO: 77 - DNA, 2666 bp, Human immunodeficiency virus type 1
  isolate=96ZM651.8;  gene=tat
atggagccagtagatcctagcatagagccctggaaccatccaggaagtcagcctaaaactgcttgtaataagtgttattgcaaacgctgtagctatcattgtctagtttgctttcagacaaaaggcttaggcatttcatatggcaggaagaagcggagacagcgacgcagcactcctcctagcagcgaggaccatcaagatcctatatcaaagcagtaagtatatgtaatgttagatttactagcaagagtaaattatagagtaggagtaggagcattgatagtagcactactcatagcaatagttgtgtggaccatagcatatatagaatataggaagctgttaagacaaagaaaaatagactggttaattaaaagaattagggaaagagcagaagacagtggcaatgagagtgagggagatactgaggaattggcaacgatggtggacatggggcatcttaggcttttggatgttaatgatttgtaatgtgtgggggaacttgtgggtcacagtctattatggggtacctgtgtggaaagaagcaaaaactactctattctgtgcatcagatgctaaatcatatgagaaagaagtgcataatgtctgggctacacatgcctgtgtacccacagaccccaacccacaagaaatagttttgggaaatgtaacagaaaattttaacatgtggaaaaatgacatggtggatcagatgcatgaggatataatcagtttatgggatcaaagcctaaagccatgtgtaaagttgaccccactctgtgtcactttaaattgtacagaggttaatgttaccagaaatgttaataatagcgtggttaataataccacaaatgttaataatagcatgaatggagacatgaaaaattgctctttcaacataaccacagaactaaaagataagaaaaagaatgtgtatgcacttttttataaacttgatatagtatcacttaatgagactgacgactctgagactggcaactctagtaaatattatagattaataaattgtaatacctcagccctaacacaagcctgtccaaaggtctcttttgacccaattcctatacattattgtgctccagctggttatgcgattctaaagtgtaataataagacattcaatgggacaggaccatgccataatgtcagcacagtacaatgtacacatggaattaagccagtggtatcaactcaactactgttaaatggtagcctagcagaagaagggataataattagatctgaaaatctgacaaacaatgtcaaaacaataatagtacatcttaatagatctatagaaattgtgtgtgtaagacccaacaataatacaagacaaagtataagaataggaccaggacaaacattctatgcaacaggagacataataggagacataagacaagcacattgtaacattagtaggactaactggactaagactttacgagaggtaaggaacaaattaagagaacacttccctaataaaaacataacatttaaaccatcctcaggaggggacctagaaattacaacacatagctttaattgtagaggagaatttttctattgcaatacatcgggcctgtttagtataaattatacagaaaataatacagatggtacacccatcacactcccatgcagaataagacaaattataaatatgtggcaggaagtaggacgagcaatgtacgcccctcccattgaaggaaacatagcatgtaaatcagatatcacagggctactattggttcgggatggaggaagcacaaatgatagcacaaataataacacagagatattcagacctgcaggaggagatatgagggacaattggaggagtgaattgtataagtataaagtggtagaaattaagccattgggaatagcacccactgaggcaaaaaggagagtggtggagagagaaaaaagagcagtgggaataggagctgtgttccttgggttcttgggagcagcaggaagcactatgggcgcagcgtcaataacgctgacggcacaggccagacaagtgttgtctggtatagtgcaacagcaaagcaatttgctgagggctatagaggcgcaacagcatctgttgcaactcacggtctggggcattaagcagctccagacaagagtcctggctatagaaagatacctaaaggatcaacagctcctaggactttggggctgctctggaaaactcatctgcaccactgctgtgccttggaacatcagttggagtaataaatctaaaacagatatttgggataacatgacctggatgcagtgggatagagaaattagtaattacacaaacacaatatacaggttgcttgaggactcgcagagccagcaggagcaaaatgaaaaagatttattagcattggacagttggaacaatctgtggaattggtttgacataacaaaatggctgtggtatataaaaatatttataatgatagtaggaggcttaataggtttgagaataatttttgctgtactctctatagtgaatagagttaggcagggatactcacctttgtcgtttcagacccttatcccgaacccaagggaacccgacaggccaggaagaatcgaagaagaaggtggagagcaagacaaagagagatccgtgcgattag

SEQ ID NO: 78 - DNA, 2684 bp, Human immunodeficiency virus type 1
  isolate=96ZM651.8; gene=rev
atggcaggaagaagcggagacagcgacgcagcactcctcctagcagcgaggaccatcaagatcctatatcaaagcagtaagtatatgtaatgttagatttactagcaagagtaaattatagagtaggagtaggagcattgatagtagcactactcatagcaatagttgtgtggaccatagcatatatagaatataggaagctgttaagacaaagaaaaatagactggttaattaaaagaattagggaaagagcagaagacagtggcaatgagagtgagggagatactgaggaattggcaacgatggtggacatggggcatcttaggcttttggatgttaatgatttgtaatgtgtgggggaacttgtgggtcacagtctattatggggtacctgtgtggaaagaagcaaaaactactctattctgtgcatcagatgctaaatcatatgagaaagaagtgcataatgtctgggctacacatgcctgtgtacccacagaccccaacccacaagaaatagttttgggaaatgtaacagaaaattttaacatgtggaaaaatgacatggtggatcagatgcatgaggatataatcagtttatgggatcaaagcctaaagccatgtgtaaagttgaccccactctgtgtcactttaaattgtacagaggttaatgttaccagaaatgttaataatagcgtggttaataataccacaaatgttaataatagcatgaatggagacatgaaaaattgctctttcaacataaccacagaactaaaagataagaaaaagaatgtgtatgcacttttttataaacttgatatagtatcacttaatgagactgacgactctgagactggcaactctagtaaatattatagattaataaattgtaatacctcagccctaacacaagcctgtccaaaggtctcttttgacccaattcctatacattattgtgctccagctggttatgcgattctaaagtgtaataataagacattcaatgggacaggaccatgccataatgtcagcacagtacaatgtacacatggaattaagccagtggtatcaactcaactactgttaaatggtagcctagcagaagaagggataataattagatctgaaaatctgacaaacaatgtcaaaacaataatagtacatcttaatagatctatagaaattgtgtgtgtaagacccaacaataatacaagacaaagtataagaataggaccaggacaaacattctatgcaacaggagacataataggagacataagacaagcacattgtaacattagtaggactaactggactaagactttacgagaggtaaggaacaaattaagagaacacttccctaataaaaacataacatttaaaccatcctcaggaggggacctagaaattacaacacatagctttaattgtagaggagaatttttctattgcaatacatcgggcctgtttagtataaattatacagaaaataatacagatggtacacccatcacactcccatgcagaataagacaaattataaatatgtggcaggaagtaggacgagcaatgtacgcccctcccattgaaggaaacatagcatgtaaatcagatatcacagggctactattggttcgggatggaggaagcacaaatgatagcacaaataataacacagagatattcagacctgcaggaggagatatgagggacaattggaggagtgaattgtataagtataaagtggtagaaattaagccattgggaatagcacccactgaggcaaaaaggagagtggtggagagagaaaaaagagcagtgggaataggagctgtgttccttgggttcttgggagcagcaggaagcactatgggcgcagcgtcaataacgctgacggcacaggccagacaagtgttgtctggtatagtgcaacagcaaagcaatttgctgagggctatagaggcgcaacagcatctgttgcaactcacggtctggggcattaagcagctccagacaagagtcctggctatagaaagatacctaaaggatcaacagctcctaggactttggggctgctctggaaaactcatctgcaccactgctgtgccttggaacatcagttggagtaataaatctaaaacagatatttgggataacatgacctggatgcagtgggatagagaaattagtaattacacaaacacaatatacaggttgcttgaggactcgcagagccagcaggagcaaaatgaaaaagatttattagcattggacagttggaacaatctgtggaattggtttgacataacaaaatggctgtggtatataaaaatatttataatgatagtaggaggcttaataggtttgagaataatttttgctgtactctctatagtgaatagagttaggcagggatactcacctttgtcgtttcagacccttatcccgaacccaagggaacccgacaggccaggaagaatcgaagaagaaggtggagagcaagacaaagagagatccgtgcgattagtgagcggattcttagcacttgcctgggacgacctacggagcctgtgcctcttcagctaccaccgattgagagacttcatattggtgacagcgagagcggtggagcttctgagacgcagcagtctcaagggactacagagggggtgggaagcccttaa

SEQ ID NO: 79 - DNA, 261 bp, Human immunodeficiency virus type 1
  isolate=96ZM651.8; gene=vpu
atgttagatttactagcaagagtaaattatagagtaggagtaggagcattgatagtagcactactcatagcaatagttgtgtggaccatagcatatatagaatataggaagctgttaagacaaagaaaaatagactggttaattaaaagaattagggaaagagcagaagacagtggcaatgagagtgagggagatactgaggaattggcaacgatggtggacatggggcatcttaggcttttggatgttaatgatttgtaa

SEQ ID NO: 80 - DNA, 2607 bp, Human immunodeficiency virus type 1
  isolate=96ZM651.8; gene=env
atgagagtgagggagatactgaggaattggcaacgatggtggacatggggcatcttaggcttttggatgttaatgatttgtaatgtgtgggggaacttgtgggtcacagtctattatggggtacctgtgtggaaagaagcaaaaactactctattctgtgcatcagatgctaaatcatatgagaaagaagtgcataatgtctgggctacacatgcctgtgtacccacagaccccaacccacaagaaatagttttgggaaatgtaacagaaaattttaacatgtggaaaaatgacatggtggatcagatgcatgaggatataatcagtttatgggatcaaagcctaaagccatgtgtaaagttgaccccactctgtgtcactttaaattgtacagaggttaatgttaccagaaatgttaataatagcgtggttaataataccacaaatgttaataatagcatgaatggagacatgaaaaattgctctttcaacataaccacagaactaaaagataagaaaaagaatgtgtatgcacttttttataaacttgatatagtatcacttaatgagactgacgactctgagactggcaactctagtaaatattatagattaataaattgtaatacctcagccctaacacaagcctgtccaaaggtctcttttgacccaattcctatacattattgtgctccagctggttatgcgattctaaagtgtaataataagacattcaatgggacaggaccatgccataatgtcagcacagtacaatgtacacatggaattaagccagtggtatcaactcaactactgttaaatggtagcctagcagaagaagggataataattagatctgaaaatctgacaaacaatgtcaaaacaataatagtacatcttaatagatctatagaaattgtgtgtgtaagacccaacaataatacaagacaaagtataagaataggaccaggacaaacattctatgcaacaggagacataataggagacataagacaagcacattgtaacattagtaggactaactggactaagactttacgagaggtaaggaacaaattaagagaacacttccctaataaaaacataacatttaaaccatcctcaggaggggacctagaaattacaacacatagctttaattgtagaggagaatttttctattgcaatacatcgggcctgtttagtataaattatacagaaaataatacagatggtacacccatcacactcccatgcagaataagacaaattataaatatgtggcaggaagtaggacgagcaatgtacgcccctcccattgaaggaaacatagcatgtaaatcagatatcacagggctactattggttcgggatggaggaagcacaaatgatagcacaaataataacacagagatattcagacctgcaggaggagatatgagggacaattggaggagtgaattgtataagtataaagtggtagaaattaagccattgggaatagcacccactgaggcaaaaaggagagtggtggagagagaaaaaagagcagtgggaataggagctgtgttccttgggttcttgggagcagcaggaagcactatgggcgcagcgtcaataacgctgacggcacaggccagacaagtgttgtctggtatagtgcaacagcaaagcaatttgctgagggctatagaggcgcaacagcatctgttgcaactcacggtctggggcattaagcagctccagacaagagtcctggctatagaaagatacctaaaggatcaacagctcctaggactttggggctgctctggaaaactcatctgcaccactgctgtgccttggaacatcagttggagtaataaatctaaaacagatatttgggataacatgacctggatgcagtgggatagagaaattagtaattacacaaacacaatatacaggttgcttgaggactcgcagagccagcaggagcaaaatgaaaaagatttattagcattggacagttggaacaatctgtggaattggtttgacataacaaaatggctgtggtatataaaaatatttataatgatagtaggaggcttaataggtttgagaataatttttgctgtactctctatagtgaatagagttaggcagggatactcacctttgtcgtttcagacccttatcccgaacccaagggaacccgacaggccaggaagaatcgaagaagaaggtggagagcaagacaaagagagatccgtgcgattagtgagcggattcttagcacttgcctgggacgacctacggagcctgtgcctcttcagctaccaccgattgagagacttcatattggtgacagcgagagcggtggagcttctgagacgcagcagtctcaagggactacagagggggtgggaagcccttaagtatctgggaagtcttgtgcagtattggggtctggagctaaaaaagagtgctattagtctacttgataccatagcaatagcagtagctgaaggaacagataggattatagaattaatacaaggaatttgtagagctatccgcaacgtacctagaagaataagacagggctttgaaacagctttgctataa

SEQ ID NO: 81 - DNA, 621 bp, Human immunodeficiency virus type 1
  nef
atggggggcaagtggtcaaaaagcagtatagttggatggcctgctgtaagagagagaataagaagaactgagccagcagcagagggagtaggagcagcgtctcaagacttagataaatatggagcacttacaagcagcaacacaagtaccactaatgctgcttgtgcctggctggaagcacaagaggaggaagaagttggctttccagtcagacctcaggtgcctttaagaccaatgacttataaggcagcagtcgatctcagcttctttttaaaagaaaaggggggactggaagggttaatttactctaagaaaaggcaagaaatccttgatttgtgggtctatcacacacaaggcttcttccctgactggcaaaactacacaccgggaccaggggtcagatatccactgacctttggatggtgcttcaagctagtgccagttgatccaggggaagtagaagaggccaacgaaggagaaaacaactgtctgctacaccctatgagccagcaaggaatggatgatgatcacagagaagtattaaagtggaagtttgacagtcacctagcacataaacacatggcccgagagctacatccggagtattacaaagactgctga

SEQ ID NO: 82 - DNA, 1496 bp, Human immunodeficiency virus type 1
  isolate=96ZM751.3; gene=gag
atgggtgcgagagcgtcaatattaagaggcggaaaattagatgaatgggaaagaattaggttaaggccagggggaaaaaagcactatatgatgaaacacttaatatgggcaagcagggagctggaaagatttgcacttaaccctggccttttagagacatcagaaggctgtaaacaaataatacaacagctacaaccagctctccagacaggaacagaggaacttaggtcattatataatacagtagcaactctctattgtgtacatgaaaagataaaggtacgagacaccaaggaagccctagacaagatagaggaagaacaaaacaaaagtcaacaaaaaatacaaaaaacagaagcgactggcggaaaggtcagtcaaaattatcctatagtgcagaatctccaagggcaaatggtacaccaggctatatcacctagaactttgaatgcatgggtaaaagtaatagaggagaagggtttcaacccagaggtaatacccatgtttacagcattatcagaaggagccaccccacaagatctaaacaccatgttaaatacagtggggggacatcaagcagccatgcaaatgttaaaagataccatcaatgaggaagctgcagaatgggataggttacatccagtacatgcagggcctattgcaccaggccaaataagagaaccaaggggaagtgacatagcaggaactactggtacccttcaggaacaaatagcatggatgacaaataacccacctattccagtgggagacatctataaaagatggataattctggggttaaataaaatagtaagaatgtacagccctgtcagcattctggacataaaacaaggaccaaaggaaccctttagggactatgtagatcggttctttaaaactttaagagctgaacaagctacacaagatgtaaaaattggatgacagacaccttgttggttcaaaatgcgaacccagattgtaagaccattttaagggcattaggaccaggggctacattagaagaaatgatgacagcatgtcagggagtggggggacctggccacaaagcaagagttttggctgaagcaatgagccaagtaaacaatacaaacataatgatgcagaaaagcaattttaaaggccctaaaagaattgttaaatgtttcaactgtggcagggaagggcatatagccaggaattgcagggctcctgggaaaaaaggctgttggaaatgtggaaaggaaggacaccaaatgaaagactgtactgagagacaggctaattttttagggaaaatttggccttcccagaaggggaggccggggaacttccttcagaacagaccagagccaacagccccaccagctccaacagccccaccagcagagagcttcaggttcgaggagacaacccctgccccgaggcaggagcagaaagacaaggaacccttaactgccctcaaatcactctttggcagcgaccccttgtctcaataa

SEQ ID NO: 83 - DNA, 3017 bp, Human immunodeficiency virus type 1
  isolate=96AM751.3; gene=pol
ttttttagggaaaatttggccttcccagaaggggaggccggggaacttccttcagaacagaccagagccaacagccccaccagctccaacagccccaccagcagagagcttcaggttcgaggagacaacccctgccccgaggcaggagcagaaagacaaggaacccttaactgccctcaaatcactctttggcagcgaccccttgtctcaataaaagtagggggtcagataaaggaggctctcttggatacaggagcagatgatacagtattagaagaaataaatttgccaggaaaatggaaaccaaaaatgataggaggaattggaggttttatcaaagtaagacagtatgatcaaatacttatagaaatttgtggaaaaaaggctataggtacagtattagtaggacctacacctgtcaacataattgggagaaatatgttgacccagcttggctgcacactaaattttccaattagtcctattgaaactgtaccagtaaaattaaagccaggaatggatggcccaagggtcaaacaatggccattgacagaagaaaaaataaaagcattaacagcaatttgtgaagaaatggaaaaggaaggaaaaattacaaaaattggccctgagaatccatataacactccagtatttgccataaaaaagaaggacagtactaagtggagaaaattagtagatttcagggaactcaataaaagaactcaggacttttgggaagttcaattaggaataccacacccagcggggttaaaaaagaaaaagtcagtgacagtactggatgtgggggatgcgtatttttcagttcctttagatgaaggcttcaggaaatatactgcattcaccatacctagtataaacaatgaaacacctgggattagatatcaatataatgtgcttccacagggatggaaaggatcaccatcaatattccagagtagcatgataaaaatcttagagccctttaggacacaaaacccagaaatagttatctatcaatatatggatgacttgtatgtaggatctgatttagaaatagggcaacacagagcaaaaatagaggagttaagagaacacctattgagatggggatttactacaccagacaagaagcatcagaaagagcccccatttctttggatggggtatgaactccatcctgacaaatggacagtacagcctataaagctgccagaaaaggagagctggactgtcaatgatatacagaagttagtgggaaaattaaactggcaagtcagatttacgcagggattaaagtaaggcaactgtgtaaactccttaggggagccaaagcactaacagacatagtaccattgactgaagaggcagaattagaattggcagagagcagggaaattctaaaagaaccagtacatggagtatattatgacccatcaaaagacttaatagctgaaatacagaaacaagggcatgaccaatggacatatcaagtttaccaagaaccattcaaaaatctgaaaacaggaaagtatgcaaaaatgaggactgcccacactaatgatgtaaaacagttaacagaggcggtgcaaaaaatagccatggaaagcatagtaatatggggaaagattcctaaatttaggctacccattcaaaaagaaacatgggagacatggtggacagactattggcaagccacctggattcctgagtgggagtttgttaatactccccccctagtaaaattatggtaccagctggagaaagaacccatagcaggagcagaaacttactatgtagatggagcagccaatagggaaactaaaataggaaaagcagggtatgttactgacagaggaaggcaaaaaattgttactctaactgaaacaacaaatcaaaagactgaattacaagcaattcagttagctttgcaggattcaggatcagaagtaaacatagtaacagactcacagtatgcattaggaatcatccaagcacaaccagataagagtgaatcagaattagtcaatcaaataatagaacagttgataaaaaaggaaagggtttacctgtcatgggtaccagcacacaaaggaattggaggaaatgaacaagtagataaattggtaagtagtggaatcaggaaagtgctgtttctagatggaatagataaggctcaagaagagcatgaaaaatatcacagcaattggagagcaatggctagtgagtttaatctgccacccatagtagcaaaagaaatagtagccagctgtgataaatgtcagctaaaaggggaagccatacatggacaagtagactgtagtccaggaatatggcaattagattgtacccatttagaaggaaaagtcatcttggtagcagtccatgtagccagtggttacatagaagcagaggtcaccccagcggaaacaggacaagaaacagcacttttcatactaaaattagcaggaagatggccagtcaaagtagtacatacagacaatggcagtaatttcaccagtgctgcagtcaaggcagcctgttggtgggcaggtatccaccaggaatttggaattccctacaatccccaaagtcaaggagtagtagaatccatgaataaagaattaaagaaaattatagggcaggtaagagatcaagctgagcaccttaagacagcagtacaaatggcagtattcattcacaattttaaaagaaaaggggggattggggggtacagtgcaggggaaagaataatagacataatagcaacagacatacaaactagagaattacaaaaacaaattataaaaattcaaaattttcgggtttattacagagacagcagagaccctatttggaaaggaccagccaaactactctggaaaggtgaaggggcagtagtaatacaagataatagtgacataaaggtaataccaaggaggaaagcaaaaatcattagggactatggaaaacagatggcaggtactgatagtgtggcaggtagacaggatgaagattag

SEQ ID NO: 84 - DNA, 579 bp, Human immunodeficiency virus type 1
  isolate=96ZM751.3; gene=vif
atggaaaacagatggcaggtactgatagtgtggcaggtagacaggatgaagattagaacatggaatagtttagtaaagcaccatatgtatgtttcaaaaagaactggtagatggttttacagacatcattatgaaagcagacatccaaaaataagttcagaagtacacatcccattaggggatgccaaattagtaataaaaacatattgggggctgcatccaggggaaagagaatggcatttgggtcatggagtctccatagaatggagattgagaagatacagcacacaagtagaccctggcctggcagaccagctaattcatatgcattattttaattgttttgcagactctgccataagaaaagccctactaggacatatagttattcctaggtgtgattatcaagcaggacataataaggtaggatccctacaatacttggcactgacagcattgataaaaccaaaaaagataaagccacctttacctagtgttaggaaattagtagaggatagatggaacaagccccagaaaaccaagggccgcagagggaaccatataatgaatgggcactag

SEQ ID NO: 85 - DNA, 291 bp, Human immunodeficiency virus type 1
  isolate=96ZM751.3; gene=vpr
atggaacaagccccagaaaaccaagggccgcagagggaaccatataatgaatgggcactagagcttttagaggagctcaagcaggaagctgtcagacactttcctagaacatggctccataacttaggacaacatatctaccaaacctacggggatacttggacgggggttgaagctctaataagaatactgcaacaactactgtttattcatttcagaattggatgccaacatagcagaataggcattatgcgacagagaagagcaagaaatggagccagtagatcctag

SEQ ID NO: 86 - DNA, 2646 bp, Human immunodeficiency virus type 1
  isolate=96AM751.3; gene=tat
atggagccagtagatcctagactagagccctggaatcatccaggaagtcaacctaaaactccttgtaataagtgttattgtaaacactgtagctatcattgtctagtttgctttcagacaaaaggcttaggcatttcctatggcaggaagaagcggagacaacgacgaagcgctcctccaagcagtgaggatcatcaaaatcctatatcaaagcagtaagtacaaagtaatagatgtaatgttaaatttagaagcaagagtagattatagaataggagtaggagcattaatagcagcactaatcatagcaatagctgtgtggatcatagtatatatagaatatagaaaattgtcaagacaaagaaaaatagaccggttaattaaaagaattagagaaagggcagaagacagtggcaatgagagtgaaggggataatgaggaattggcaacaatggtggatatggggcatcttaggcttttggatgctattgatgtgtaatgcaatggggaaattgtgggtcacagtctactatggggtacctgtgtggaaagaagcaaaaactactttattttgtgcatcagatgctaaagcatatgagacagaagtgcataatgtttgggctacacatgcctgtgtacccacagaccccaacccacaagaaatggttttggaaaatgtaacagaaaagtttaacatgtgggaaaataacatggtggatcagatgcatgaggatataatcagtttatgggaccaaagcctaaagccatgtgtaaagttgaccccactctgtgtcactttaaactgtactgctaatataaccaacaatgctaatataaccaacaatgctaatataaccaactataataatgaaactgacatgagaaattgctctttcaatataaccacagaattaagagataagaggaggcaagtagatgcactcttttataaacttgatatagtaccaattaatgagaattccagtgaatatagattaataaattgtaatacctcggccataacacaagcatgtccaaaggttacttttgacccaatccctatacattattgtgctccagctggttatgcgattctaaagtgtaacaataagacattcaatggaacaggaccatgcaataatgtcagcacagtacaatgtacacatggaattaagccagtagtatcaactcaattactgttaaatggtagtctagcagaagaagagataataattagatctaaaaatatgacagacaatgccaaaataataatagtacatcttaatgaatctgtagaaattgtgtgtacaagacccaacaataatacaaggaaaagtgtgaggataggaccaggacaaacattctatgcaacaggagaaataataggaaatataagacaagcatattgtaacatcagtgaaggcaaatggaataacactctacaaagggtaggtgaaaaattaagaaaatacttccctaataaaacaataagctttgcaccatcctcaggaggggacctagaaattacaacacatagctttaattgtagaggagaatttttctattgcaatacatcaaaactgtttaatggtacgtttaatggtacaaacacttctaatgatagaagtaattcgaccattacgcttcaatgcagaataaaacaaattacaaacatgtggcagggggtaggacaagcaatgtatgctcctccaattaaaggaaacataacatgtaaatcaaatatcacaggactactattaacacgtgatggagggacaaatgacacagagacaccagagacattcagacctggaggaggagacatgaaggacaattggagaagtgaattatataaatataaagtggtagaaattaagccattaggagtagcacccactaaggcacgaaggagagtggtggagagagaaaaaagagcagtaggaataggagctgtgttccttgggttcttgggagcagcaggaagcactatgggcgcagcatcaataacgctgacggtacaggtcagacaattattgtctggtatagtgcaacagcaaagcaatttgctgagggctatagaggcgcaacagcacatgttgcaactcacagtctggggcattaagcagctccaggcaagagtcttggctatagaaagatacctaaaggatcaacagctcctagggatttggggctgctctggaaaactcatctgcaccactgctgtgccttggaactctagttggagcaacaaatctgaacgggagatttgggataacatgacctggatgcagtgggatagagaaattaataattacacagaaacaatatataggttgcttgaagtctcgcaaaaccagcaggaaaataatgaaagggatttactagcattggacagttgaaaaaatctgtggaattggtttaatataacaaattggctgtggtatataaaaatattcataatgataataggaggcttgataggtttaagaataatttttgctgtgctctctatagtaaatagagttaggcaggggtactcacctttgtcgttgcagacccttatcccaaccccgagggaaccagacaggctcggaagaatcgaagaagaaggtggagagcaagacagagacagatcaattcgattag

SEQ ID NO: 87 - DNA, 2631 bp, Human immunodeficiency virus type 1
  isolate=96ZM751.3; gene=rev
atggcaggaagaagcggagacaacgacgaagcgctcctccaagcagtgaggatcatcaaaatcctatatcaaagcagtaagtacaaagtaatagatgtaatgttaaatttagaagcaagagtagattatagaataggagtaggagcattaatagcagcactaatcatagcaatagctgtgtggatcatagtatatatagaatatagaaaattgtcaagacaaagaaaaatagaccggttaattaaaagaattagagaaagggcagaagacagtggcaatgagagtgaaggggataatgaggaattggcaacaatggtggatatggggcatcttaggcttttggatgctattgatgtgtaatgcaatggggaaattgtgggtcacagtctactatggggtacctgtgtggaaagaagcaaaaactactttattttgtgcatcagatgctaaagcatatgagacagaagtgcataatgtttgggctacacatgcctgtgtacccacagaccccaacccacaagaaatggttttggaaaatgtaacagaaaagtttaacatgtgggaaaataacatggtggatcagatgcatgaggatataatcagtttatgggaccaaagcctaaagccatgtgtaaagttgaccccactctgtgtcactttaaactgtactgctaatataaccaacaatgctaatataaccaacaatgctaatataaccaactataataatgaaactgacatgagaaattgctctttcaatataaccacagaattaagagataagaggaggcaagtagatgcactcttttataaacttgatatagtaccaattaatgagaattccagtgaatatagattaataaattgtaatacctcggccataacacaagcatgtccaaaggttacttttgacccaatccctatacattattgtgctccagctggttatgcgattctaaagtgtaacaataagacattcaatggaacaggaccatgcaataatgtcagcacagtacaatgtacacatggaattaagccagtagtatcaactcaattactgttaaatggtagtctagcagaagaagagataataattagatctaaaaatatgacagacaatgccaaaataataatagtacatcttaatgaatctgtagaaattgtgtgtacaagacccaacaataatacaaggaaaagtgtgaggataggaccaggacaaacattctatgcaacaggagaaataataggaaatataagacaagcatattgtaacatcagtgaaggcaaatggaataacactctacaaagggtaggtgaaaaattaagaaaatacttccctaataaaacaataagctttgcaccatcctcaggaggggacctagaaattacaacacatagctttaattgtagaggagaatttttctattgcaatacatcaaaactgtttaatggtacgtttaatggtacaaacacttctaatgatagaagtaattcgaccattacgcttcaatgcagaataaaacaaattacaaacatgtggcagggggtaggacaagcaatgtatgctcctccaattaaaggaaacataacatgtaaatcaaatatcacaggactactattaacacgtgatggagggacaaatgacacagagacaccagagacattcagacctggaggaggagacatgaaggacaattggagaagtgaattatataaatataaagtggtagaaattaagccattaggagtagcacccactaaggcacgaaggagagtggtggagagagaaaaaagagcagtaggaataggagctgtgttccttgggttcttgggagcagcaggaagcactatgggcgcagcatcaataacgctgacggtacaggtcagacaattattgtctggtatagtgcaacagcaaagcaatttgctgagggctatagaggcgcaacagcacatgttgcaactcacagtctggggcattaagcagctccaggcaagagtcttggctatagaaagatacctaaaggatcaacagctcctagggatttggggctgctctggaaaactcatctgcaccactgctgtgccttggaactctagttggagcaacaaatctgaacgggagatttgggataacatgacctggatgcagtgggatagagaaattaataattacacagaaacaatatataggttgcttgaagtctcgcaaaaccagcaggaaaataatgaaagggatttactagcattggacagttgaaaaaatctgtggaattggtttaatataacaaattggctgtggtatataaaaatattcataatgataataggaggcttgataggtttaagaataatttttgctgtgctctctatagtaaatagagttaggcaggggtactcacctttgtcgttgcagacccttatcccaaccccgagggaaccagacaggctcggaagaatcgaagaagaaggtggagagcaagacagagacagatcaattcgattagtgaacggattcttagcacttgtctgggacgacctccggagcctgtgccttttcagctaccaccgcttgagagacttcatattgattgcagcgaggggactacagagggggtgggaaactcttaa

SEQ ID NO: 88 - DNA, 261 bp, Human immunodeficiency virus type 1
  isolate=96AM751.3; gene=vpu
atgttaaatttagaagcaagagtagattatagaataggagtaggagcattaatagcagcactaatcatagcaatagctgtgtggatcatagtatatatagaatatagaaaattgtcaagacaaagaaaaatagaccggttaattaaaagaattagagaaagggcagaagacagtggcaatgagagtgaaggggataatgaggaattggcaacaatggtggatatggggcatcttaggcttttggatgctattgatgtgtaa

SEQ ID NO: 89 - DNA, 2544 bp, Human immunodeficiency virus type 1
  isolate=96AM751.3; gene=env
atgagagtgaaggggataatgaggaattggcaacaatggtggatatggggcatcttaggcttttggatgctattgatgtgtaatgcaatggggaaattgtgggtcacagtctactatggggtacctgtgtggaaagaagcaaaaactactttattttgtgcatcagatgctaaagcatatgagacagaagtgcataatgtttgggctacacatgcctgtgtacccacagaccccaacccacaagaaatggttttggaaaatgtaacagaaaagtttaacatgtgggaaaataacatggtggatcagatgcatgaggatataatcagtttatgggaccaaagcctaaagccatgtgtaaagttgaccccactctgtgtcactttaaactgtactgctaatataaccaacaatgctaatataaccaacaatgctaatataaccaactataataatgaaactgacatgagaaattgctctttcaatataaccacagaattaagagataagaggaggcaagtagatgcactcttttataaacttgatatagtaccaattaatgagaattccagtgaatatagattaataaattgtaatacctcggccataacacaagcatgtccaaaggttacttttgacccaatccctatacattattgtgctccagctggttatgcgattctaaagtgtaacaataagacattcaatggaacaggaccatgcaataatgtcagcacagtacaatgtacacatggaattaagccagtagtatcaactcaattactgttaaatggtagtctagcagaagaagagataataattagatctaaaaatatgacagacaatgccaaaataataatagtacatcttaatgaatctgtagaaattgtgtgtacaagacccaacaataatacaaggaaaagtgtgaggataggaccaggacaaacattctatgcaacaggagaaataataggaaatataagacaagcatattgtaacatcagtgaaggcaaatggaataacactctacaaagggtaggtgaaaaattaagaaaatacttccctaataaaacaataagctttgcaccatcctcaggaggggacctagaaattacaacacatagctttaattgtagaggagaatttttctattgcaatacatcaaaactgtttaatggtacgtttaatggtacaaacacttctaatgatagaagtaattcgaccattacgcttcaatgcagaataaaacaaattacaaacatgtggcagggggtaggacaagcaatgtatgctcctccaattaaaggaaacataacatgtaaatcaaatatcacaggactactattaacacgtgatggagggacaaatgacacagagacaccagagacattcagacctggaggaggagacatgaaggacaattggagaagtgaattatataaatataaagtggtagaaattaagccattaggagtagcacccactaaggcacgaaggagagtggtggagagagaaaaaagagcagtaggaataggagctgtgttccttgggttcttgggagcagcaggaagcactatgggcgcagcatcaataacgctgacggtacaggtcagacaattattgtctggtatagtgcaacagcaaagcaatttgctgagggctatagaggcgcaacagcacatgttgcaactcacagtctggggcattaagcagctccaggcaagagtcttggctatagaaagatacctaaaggatcaacagctcctagggatttggggctgctctggaaaactcatctgcaccactgctgtgccttggaactctagttggagcaacaaatctgaacgggagatttgggataacatgacctggatgcagtgggatagagaaattaataattacacagaaacaatatataggttgcttgaagtctcgcaaaaccagcaggaaaataatgaaagggatttactagcattggacagttgaaaaaatctgtggaattggtttaatataacaaattggctgtggtatataaaaatattcataatgataataggaggcttgataggtttaagaataatttttgctgtgctctctatagtaaatagagttaggcaggggtactcacctttgtcgttgcagacccttatcccaaccccgagggaaccagacaggctcggaagaatcgaagaagaaggtggagagcaagacagagacagatcaattcgattagtgaacggattcttagcacttgtctgggacgacctccggagcctgtgccttttcagctaccaccgcttgagagacttcatattgattgcagcgaggggactacagagggggtgggaaactcttaagtatctggggagtcttgtacagtattggggtctagagctaaaaaagagtgctattagtttgcttgatactatagcaatagcagtagctgaaggaacagatagaattatagaattaacacaaagaatttgtagagctatccgcaacgtacctagaagaataagacagggctttgaagcagctttgcaataa

SEQ ID NO: 90 - DNA, 624 bp, Human immunodeficiency virus type 1
  isolate=96AM751.3; gene=nef
atgggaggcaagtggtcaaaacgcagtatagttggatggcctaaagtaagagaaagaatagcaagaactgatccagcagcagagggagtaggagcagcgtctcaagacttagataaatatggggcacttacaagcagtaacacaagtaccaataatgctgattgtgcctggctggaagcgcaagaggaggagggagaagtaggctttccagtcagacctcaggtacctttaagaccaatgacttataagtcagcatttgatctcagcttctttttaaaagaaaaggggggactggatgggttaatttactgtaagaaaagacaagaaatcctcgatttgtgggtctatcacacacaaggctacttccctgattggcaaaactatacaccgggaccagggatcagatatccactgacctttggatggtgctacaagctagtgccagttgacccaagggaagtagaagaagccaacgaaggagaggacaactgtttgctacaccctataagccagcatggaatagaagatgaagacagagaagtattaaggtggaagtttgacagttccctagcacgcagacacatggcccgcgagctacatccggagtattacaaagactgctga

SEQ ID NO: 91 - DNA, 1491 bp, Human immunodeficiency virus type 1
  isolate=94CY017.41; gene=gag
atgggtgcgagagcgtcaatattaagcgggggaaaattagatgcttgggagaaaattcggttaaggccagggggaaagaaaaaatatagactgaaacatttggtatgggcaagcagggagctggagaaattctcaattaaccctggccttttagaaacaccagagggatgtagacaaataataaggcagttacaaccagctctccaaacaggaacagaagaacttaaatcattatataatacagtagtagtcctctactgggtacatcaaagggtagatgtaaaagacaccaaggaagctctagataaaatagaggaagaacaaaacaagcagaaaacacagcatgcagcagctgacacagggaacagcagcagtcaaaattatcccatagtgcaaaatgcacaagggcaaatggtacaccaggctatatcacctaggacgttgaatgcctgggtcaaagtagtagaagaaaaggctttcagcccagaagtaatacctatgtttacagcattatcagaaggagccaccccacaagacttaaatactatgctaaacacagtggggggacatcaagcagctatgcaaatgttaaaagataccatcaatgaggaagctgcagaatgggacagggtacatccagtacatgcagggcctattccaccaggccagatgagagaaccaaggggaagtgacatagcaggaactactagtacccttcaggaacaaataggttggatgaccagcgatccacccatcccagtgggagaaatttataaaagatggataatcctgggattaaataaaatagtaagaatgtatagccctgtcagcattttggacataagacaagggccaaaagaaccctttagagattatgtggataggttctttaaaactctaagagctgagcaagccacacaggaggtaaaaaactggatgacggacaccttgctggtccaaaatgcgaacccagattgtagatccatcttgagagcattaggaccaggggcctcattagaagaaatgatgacagcatgtcagggagtgggaggacccagccataaagcaagggttttggctgaagcaatgagccatgtacaaagtacaaatacaaacataatgatgcagagaggcaattttaggggtcaaaaaagaattaagtgtttcaactgtggcaaggaaggacacctagccagaaattgcagggcccctaggaaaaagggctgctggaaatgtggaaaggaaggacatcaaatgaaagattgcactgagagacaggctaattttttagggaaaatttggccttccaacaaagggaggccaggaaattttcctcagagcagaacagagccaacagccccaccagcagagaacttgagaatgggggaagagataacctcctccctgaagcaggaactggagaccagggaaccatacaatcctgcaatttccctcaaatcactctttggcaacgaccccttgttacagtaa

SEQ ID NO: 92 - DNA, 3012 bp, Human immunodeficiency virus type 1
  isolate=94CY017.41; gene=pol
ttttttagggaaaatttggccttccaacaaagggaggccaggaaattttcctcagagcagaacagagccaacagccccaccagcagagaacttgagaatgggggaagagataacctcctccctgaagcaggaactggagaccagggaaccatacaatcctgcaatttccctcaaatcactctttggcaacgaccccttgttacagtaaagatagagggacagctaaaagaagctctattagatacaggagcagatgatacagtgttagaagaaataaatttgccaggaaaatggaaaccaaaaatgatagggggaattggaggttttatcaaagtaagacaatatgatcagatagctatagaaatttgtggaaaaagggccataggtacagtattagtaggacctacccctgtcaacataatcggaagaaatatgttggttcagcttggttgtactttaaattttccaattagtcctattgaaactgtaccagtaaaattaaagccaggaatggatggtccaaaggttaaacaatggccattgacagaagaaaaaataaaagcattaacagaaatctgtaaagaaatggaaaaggaaggaaaaatttcaaaaattgggcctgaaaatccatacaacactccagtgtttgctataaagaaaaaagacagcactaaatggagaaaattagtagattttagagaactcaataagagaactcaagacttctgggaagttcagttaggaataccacatccagcaggattaaaaaagaaaaaagcagtaacagtacttgatgtgggggacgcatatttttccgttcccttacatgaagacttcagaaaatatactgcattcaccatacctagtaccaacaatgagacaccaggagttaggtatcagtacaatgtacttccacagggatggaaaggatcaccagcaatattccagagtagcatgacaaagatcttagagccctttagatcaaagaatacagaattaatcatctaccaatacatggatgacttgtatgtaggatctgatttagaaataagccagcatagagtaaaaatagaggaattaagggctcacttattgaaatggggattttatacaccagacaaaaaacatcagaaagaacctccatttctttggatgggatatgagcttcatcctgacaaatggacagtccagcctataaagctgccagaaaaagacagctggactgtcaatgatatacagaaattagtagggaaattaaattgggcaagtcagatttatgcagggattaaagtaaagcaactgtgtaaactccttagaggagccaaagcactaacagacatagtaacactgactaaagaagcagagttagaattagaagagaacagggaaattttaaaaacccctgtacatggggtatactatgacccatcaaaagacttaatagcagaaatacagaaacaagggcaagaccaatggacatatcaaatttatcaggaaccctttaagaatctgaaaacagggaaatatgcaaaaaggaggtccacccacactaatgatataaaacagttaacagaagcagtacaaaaaataaccatggaaagcatagtgatatggggaaagactcctaaatttaaattacccatacaaaaggaaacatgggagacatggtgggcggagtattggcaggctacctggattcctgagtgggagtttgtcaatacccctcctctagtaaaactgtggtaccagttagaaaaagaacccatagcaggagcagaaactttctatgtagatggggcagctaatagagagactaaactaggaaaggcagggtatgtcactgacagaggaagacaaaaaattgtctccctgacggagacaacaaatcaaaagactgaattacatgcaatctatttggctttacaggattcaggattagaagtgaacatagtgacagattcacagtatgcattaggaatcattcaagcacaaccagaaaggagtgaatcagagatagtcaatcaaataatagaaaaattaatagaaaaggaaagggtctacctatcatgggtaccagcacacaaagggattggaggaaatgaacaagtagacaaattagtcagttctggaatcaggaaagtgctatttttagatgggatagataaggctcaagaggaacatgaaagatatcacagcaattggagagcaatggctcatgactttaatctaccacctgtagtagcaaaagaaatagtagctagctgtgataaatgtcagctaaaaggggaagccatgcatggacaagtagactgtagtccaggaatatggcaactagattgcacacatcttgaaggaaaagttatcctggtggcagtccatgtggccagtggctatatagaagcagaagtcatcccaacagaaacaggacaggatacagcatactttatattaaaactagcaggaagatggccagtaaaagtaatacatacagacaatgggcccaatttcatcagtgcaacagttaaggcagcctgttggtgggcaggtatccaacaagaatttgggattccctacaatccccaaagtcaaggagtagtggaatctatgaataaagaattaaagaaaatcatagggcaggtaagagatcaagctgaacaccttaagacagcagtacaaatggcagtattcattcacaattttaaaagaaaaggggggattgggggatacagtgcaggggaaagaataatagacataatagcaacagatatacaaactaaagaactacaaagacaaattacaaaaattcaaaattttcgggtttattacagggacagcagagatccaatttggaaaggaccagcaaaactcctttggaaaggtgaaggggcagtagtaatacaagacaatagtgacataaaggtagtaccaagaagaaaagcaaagatcattagggattatggaaaacagatggcaggtgatgattgtgtggcaggtagacaggatgaggattag

SEQ ID NO: 93 - DNA, 579 bp, Human immunodeficiency virus type 1
  isolate=94CY017.41; gene=vif
atggaaaacagatggcaggtgatgattgtgtggcaggtagacaggatgaggattagaacatggaacagtttagttaaacatcatatgtatatttcaaggaaagctaaaggttgggtctataaacatcactatgaaagcagaaatccaagaataagttcagaagtacacatcccgctaggggaggctagaataatagtaagaacatattggggtctgcacataggagaaaaagactggcacttgggtcatggagtctccatagaatggaggcaaaacaggtatcatacacaaatagaccctgatctggcagaccatctaatccatctgtattattttgactgtttttcagaatctgccataaggaaagccataataggagaaatagttagtcctaggtgtgaatatcaagcaggacataacaaggtagggtctctgcaatatttggcattgaaagcagtagtagcttcaacaaggacaaagccacctttgcctagtgttaggaaattagtagaggatagatggaacaagccccagaagaccaagggccacagagggagccatacaatgaatggatgttag

SEQ ID NO: 94 - DNA, 291 bp, Human immunodeficiency virus type 1
  isolate=94CY017.41; gene=vpr
atggaacaagccccagaagaccaagggccacagagggagccatacaatgaatggatgttagaactgttagaggagctcaagcaggaagctgttagacatttccctaggcactggctacatggcctaggacaatacatctataatacctatggggatacctgggaaggagttgaagttatcataagatatctgcaacaactactgtttgtccatttcagaattgggtgccaacatagcaggataggcattattcgaagaagaagagtaagggatggagccagtagaccctaa

SEQ ID NO: 95 - DNA, 2655 bp, Human immunodeficiency virus type 1
  isolate=94CY017.41; gene=tat
atggagccagtagaccctaaactagagccctggaaccatccgggaagtcagcctaaaactgcttgtaccaaatgttattgtaaacgctgttgctatcattgccagttgtgctttataaacaaaggcttaggcatctcctacggcaggaagaagcgacgaccccgacgaaagccttctccaagcaataaggaccatcaaaatcctataccaaagcagtaagtagtagtaattaatatatgtaatgttacctttagtaatattggcaatagtaggactgatagtagctttaatcttagcaatagttgtatggactatagtattcatagaatataagaaaattaagaagcaaaggaaaatagactggttaatcaaaagaataagtgagagagcagaagacagtggcaatgagagtgatggggacacagaggaactatcagcacttgtggagagggggcatcttgattttggggatgttaataatgtgtaaagctacagatttgtgggtcacagtatactatggagtacctgtgtggaaagatgcagataccatcctattttgtgcatcagatgctaaagcatatgatacagaagtgcataatgtatgggccacacatgcctgtgtacccacagaccccaacccacaagaaataaacctggaaaatgtaacagaaaattttaatatgtggaaaaataacatggtagagcagatgcaagaagatataatcagcttatgggatcaaagcctaaagccatgtgtaaaattaaccccgctctgcgtcattttaaattgtagcaatgccaataccagcacccatagcaatagcagtagcacccagagccccattaatgaagaaataaaaaactgctcttacaatactaccacaatactaagagataagacacaaaaagtttattcactgttttatagacttgatgtagtacaacttgatgaaagtgaaaataagaatacatcaggtagtaatactctgtatagactaataaattgtaatacctcaaccatcacacaagcgtgtccaaaggtaacctttgagccaattcctatacattattgtgccccagctggttttgcgattctaaagtgtaaggatccgagattcaatggaacagggtcatgcaagaatgttagctcagtacaatgtacacatggaattaaaccagtagcatcaactcaactgctgttgaatggcagtctagcagaaggagggaaaataatgattagatctgaaaatattacaaacaatgccaaaaacataatagttcagtttactaagcctgtactaattacttgtatcagacccaacaacaatacaagaaaaagtatacgctttggaccaggacaagccttctatacaaatgaaataataggggacataagacaagcacattgtaatatcaacaaaacattatggaatgacactttacaaaaggtagctgaacaattaagagagaaattccctaagaaaaccataatctttactaactcctcaggaggggacccagaaattacaacacttagttttaattgtgcaggagaatttttctattgcaatacaacaggcctgtttaatggtacgtggtggaacaatggtacgtggaacgggccctacacacctaataacaccaatggaagtataatcctcccatgcagaataaaacaaattataaacatgtggcagagagtaggaagagcaatgtatgcccctcccattgcaggaataataaagtgtacatcaaacattacaggaataatattgacaagagatggtggtaacaatgggactaatgagaccttcagacctggaggaggagatatgagggacaattggagaagtgaattatataaatataaagtagtaaaacttgaaccactaggagtagcacctaccagggcaaaaagaagagtggtggagagagaaaaaagagcagttggactgggagctgtcttccttgggttcttgggagcagcaggaagcactatgggcgcggcgtcactaacgctgacggtacaggccagacaattattgtctggtatagtgcaacagcaaagcaatttgctgcaggctatagaagctcaacagcatctgttgaaactcacagtctggggcattaaacagctccaggcgagggtcctggctgtggaaagatacctaaaggatcaacagctcctgggaatttggggctgctctggaaaactcatctgcgccactactgtgccctggaacactagttggagtaataagtctcaggatgagatttgggacaacatgacctggttgcaatgggataaagaaattagcaattacacaaacataatatataggttacttgaagaatcgcaaaaccagcaggaaaagaatgagcaagacttattggcattagacaaatgggcagatttgtggagttggttcaacatttcacactggctgtggtatataagaatatttataatgatagtaggaggcttgataggattaagaatagtttttgctataattactgtagtaaatagagttaggcagggatactcacctgtgtcatttcagatccctaccccaagcccagagggtcccgacaggcccagaggaaccgaagaaggaggtggagagcaaggcagagacagatcgattcgattag

SEQ ID NO: 96 - DNA, 2721 bp, Human immunodeficiency virus type 1
  isolate=94CY017.41; gene=rev
acggcaggaagaagcgacgaccccgacgaaagccttctccaagcaataaggaccatcaaaatcctataccaaagcagtaagtagtagtaattaatatatgtaatgttacctttagtaatattggcaatagtaggactgatagtagctttaatcttagcaatagttgtatggactatagtattcatagaatataagaaaattaagaagcaaaggaaaatagactggttaatcaaaagaataagtgagagagcagaagacagtggcaatgagagtgatggggacacagaggaactatcagcacttgtggagagggggcatcttgattttggggatgttaataatgtgtaaagctacagatttgtgggtcacagtatactatggagtacctgtgtggaaagatgcagataccatcctattttgtgcatcagatgctaaagcatatgatacagaagtgcataatgtatgggccacacatgcctgtgtacccacagaccccaacccacaagaaataaacctggaaaatgtaacagaaaattttaatatgtggaaaaataacatggtagagcagatgcaagaagatataatcagcttatgggatcaaagcctaaagccatgtgtaaaattaaccccgctctgcgtcattttaaattgtagcaatgccaataccagcacccatagcaatagcagtagcacccagagccccattaatgaagaaataaaaaactgctcttacaatactaccacaatactaagagataagacacaaaaagtttattcactgttttatagacttgatgtagtacaacttgatgaaagtgaaaataagaatacatcaggtagtaatactctgtatagactaataaattgtaatacctcaaccatcacacaagcgtgtccaaaggtaacctttgagccaattcctatacattattgtgccccagctggttttgcgattctaaagtgtaaggatccgagattcaatggaacagggtcatgcaagaatgttagctcagtacaatgtacacatggaattaaaccagtagcatcaactcaactgctgttgaatggcagtctagcagaaggagggaaaataatgattagatctgaaaatattacaaacaatgccaaaaacataatagttcagtttactaagcctgtactaattacttgtatcagacccaacaacaatacaagaaaaagtatacgctttggaccaggacaagccttctatacaaatgaaataataggggacataagacaagcacattgtaatatcaacaaaacattatggaatgacactttacaaaaggtagctgaacaattaagagagaaattccctaagaaaaccataatctttactaactcctcaggaggggacccagaaattacaacacttagttttaattgtgcaggagaatttttctattgcaatacaacaggcctgtttaatggtacgtggtggaacaatggtacgtggaacgggccctacacacctaataacaccaatggaagtataatcctcccatgcagaataaaacaaattataaacatgtggcagagagtaggaagagcaatgtatgcccctcccattgcaggaataataaagtgtacatcaaacattacaggaataatattgacaagagatggtggtaacaatgggactaatgagaccttcagacctggaggaggagatatgagggacaattggagaagtgaattatataaatataaagtagtaaaacttgaaccactaggagtagcacctaccagggcaaaaagaagagtggtggagagagaaaaaagagcagttggactgggagctgtcttccttgggttcttgggagcagcaggaagcactatgggcgcggcgtcactaacgctgacggtacaggccagacaattattgtctggtatagtgcaacagcaaagcaatttgctgcaggctatagaagctcaacagcatctgttgaaactcacagtctggggcattaaacagctccaggcgagggtcctggctgtggaaagatacctaaaggatcaacagctcctgggaatttggggctgctctggaaaactcatctgcgccactactgtgccctggaacactagttggagtaataagtctcaggatgagatttgggacaacatgacctggttgcaatgggataaagaaattagcaattacacaaacataatatataggttacttgaagaatcgcaaaaccagcaggaaaagaatgagcaagacttattggcattagacaaatgggcagatttgtggagttggttcaacatttcacactggctgtggtatataagaatatttataatgatagtaggaggcttgataggattaagaatagtttttgctataattactgtagtaaatagagttaggcagggatactcacctgtgtcatttcagatccctaccccaagcccagagggtcccgacaggcccagaggaaccgaagaaggaggtggagagcaaggcagagacagatcgattcgattagtgaacgggttcttcgcacttgcctgggacgacctacggagcctgtgcctcttcagttaccaccgcttgagagattgcatattgattgcagcgaggactgtggaacttctgggacactgcagtctcaagggactgagactggggtgggaaggtctcaagaatctgtggaatcttctgttatactggggtcgggaactgaagaatag

SEQ ID NO: 97 - DNA, 246 bp, Human immunodeficiency virus type 1
  isolate=94CY017.41; gene=vpu
atgttacctttagtaatattggcaatagtaggactgatagtagctttaatcttagcaatagttgtatggactatagtattcatagaatataagaaaattaagaagcaaaggaaaatagactggttaatcaaaagaataagtgagagagcagaagacagtggcaatgagagtgatggggacacagaggaactatcagcacttgtggagagggggcatcttgattttggggatgttaataatgtgtaa

SEQ ID NO: 98 - DNA, 2598 bp, Human immunodeficiency virus type 1
  isolate=94CY017.41; gene=env
atgagagtgatggggacacagaggaactatcagcacttgtggagagggggcatcttgattttggggatgttaataatgtgtaaagctacagatttgtgggtcacagtatactatggagtacctgtgtggaaagatgcagataccatcctattttgtgcatcagatgctaaagcatatgatacagaagtgcataatgtatgggccacacatgcctgtgtacccacagaccccaacccacaagaaataaacctggaaaatgtaacagaaaattttaatatgtggaaaaataacatggtagagcagatgcaagaagatataatcagcttatgggatcaaagcctaaagccatgtgtaaaattaaccccgctctgcgtcattttaaattgtagcaatgccaataccagcacccatagcaatagcagtagcacccagagccccattaatgaagaaataaaaaactgctcttacaatactaccacaatactaagagataagacacaaaaagtttattcactgttttatagacttgatgtagtacaacttgatgaaagtgaaaataagaatacatcaggtagtaatactctgtatagactaataaattgtaatacctcaaccatcacacaagcgtgtccaaaggtaacctttgagccaattcctatacattattgtgccccagctggttttgcgattctaaagtgtaaggatccgagattcaatggaacagggtcatgcaagaatgttagctcagtacaatgtacacatggaattaaaccagtagcatcaactcaactgctgttgaatggcagtctagcagaaggagggaaaataatgattagatctgaaaatattacaaacaatgccaaaaacataatagttcagtttactaagcctgtactaattacttgtatcagacccaacaacaatacaagaaaaagtatacgctttggaccaggacaagccttctatacaaatgaaataataggggacataagacaagcacattgtaatatcaacaaaacattatggaatgacactttacaaaaggtagctgaacaattaagagagaaattccctaagaaaaccataatctttactaactcctcaggaggggacccagaaattacaacacttagttttaattgtgcaggagaatttttctattgcaatacaacaggcctgtttaatggtacgtggtggaacaatggtacgtggaacgggccctacacacctaataacaccaatggaagtataatcctcccatgcagaataaaacaaattataaacatgtggcagagagtaggaagagcaatgtatgcccctcccattgcaggaataataaagtgtacatcaaacattacaggaataatattgacaagagatggtggtaacaatgggactaatgagaccttcagacctggaggaggagatatgagggacaattggagaagtgaattatataaatataaagtagtaaaacttgaaccactaggagtagcacctaccagggcaaaaagaagagtggtggagagagaaaaaagagcagttggactgggagctgtcttccttgggttcttgggagcagcaggaagcactatgggcgcggcgtcactaacgctgacggtacaggccagacaattattgtctggtatagtgcaacagcaaagcaatttgctgcaggctatagaagctcaacagcatctgttgaaactcacagtctggggcattaaacagctccaggcgagggtcctggctgtggaaagatacctaaaggatcaacagctcctgggaatttggggctgctctggaaaactcatctgcgccactactgtgccctggaacactagttggagtaataagtctcaggatgagatttgggacaacatgacctggttgcaatgggataaagaaattagcaattacacaaacataatatataggttacttgaagaatcgcaaaaccagcaggaaaagaatgagcaagacttattggcattagacaaatgggcagatttgtggagttggttcaacatttcacactggctgtggtatataagaatatttataatgatagtaggaggcttgataggattaagaatagtttttgctataattactgtagtaaatagagttaggcagggatactcacctgtgtcatttcagatccctaccccaagcccagagggtcccgacaggcccagaggaaccgaagaaggaggtggagagcaaggcagagacagatcgattcgattagtgaacgggttcttcgcacttgcctgggacgacctacggagcctgtgcctcttcagttaccaccgcttgagagattgcatattgattgcagcgaggactgtggaacttctgggacactgcagtctcaagggactgagactggggtgggaaggtctcaagaatctgtggaatcttctgttatactggggtcgggaactgaagaatagtgctattagcttatttgatactatagcagtagcagtagctgagtggacagatagggttatagaaatagggcaaagagctttcagagctattctcaacatacctagaagaatcagacagggcttagaaagggctttactataa

SEQ ID NO: 99 - DNA, 654 bp, Human immunodeficiency virus type 1
  isolate=94CY017.41; gene=nef
atggggggcaagtggtcaaaaaggagcataccaggatggcctgctattagggagagaatgagaagaactcctccaacagcacaaagaacagaagcagtgtctccagcagcaccaggagtaggagcagtgtctcaagatttagctactcatggagcagtcacaagcagtaatacagcagctactaatcctgattgcgcctgggtggaagcgcaagaagaggagagtgaagtaggcttcccagtcaggccacaggtacctttaaggccaatgaccttcaagggagcgtttgatctcagcttctttttaaaagaaaaggggggactggatgggttaatttactcccagaaaagacaagacatccttgatatgtgggtctaccacacacaaggctacttccctgattggcagaattacacaccagggccagggatcagatacccattaacatttggatggtgcttcaagctagtaccagtagagccatctgaggtagaagaagctactcagggagagaacaacagcttattacaccctatatgccaacatggagtagatgaccctgaaagagaagtgttaagatgggagtttgatagaagcctggcacggagacacagagcccgagagctgcatccggagtactacaaagactgctga

SEQ ID NO: 100 - DNA, 1476 bp, Human immunodeficiency virus type 1
  isolate=94IN476.104; gene=gag
atgggtgcgagagcgtcaatattaagagggggaaaattagatagatgggaaaaaattcggttaaggccagggggaaagaaacattatatgataaaacacttagtatgggcaagcagggagctggaaagatttgcgcttaaccctggccttttagagacgtcagacggatgtaaacaaataataaaacagctacatccagctcttaagacaggaacagaggaacttaggtcattattcaacacagtagcaactctctattgtgtacatgcagggatagaggtacgagacaccaaggaagccttagacaagatagaggaagaacaaaacaaaagtcagcaaaaaatacagcaggcaaaagaggctgacggaaaggtcagtcaaaattatcctatagtgcaaaatctccaagggcaaatggtacaccagcccctatcacctagaactttgaatgcgtgggtaaaagtaatagaggagaaggcttttagcccagaggtaatacccatgttcacagcattatcagaaggagccaccccctctgatttaaacaccatgttaaatacagtggggggacatcaagcagccatgcaaatgttaaaagataccatcaacgaggaggctgcggaatgggatagattacatccagtacatgcagggcctaatccaccaggccagatgagagaaccaaggggaagtgatatagcaggaactactagtacccttcaggaacaaatagcatggatgacaggtaacccacctattccagtgggagacatctataaaagatggataattctggggttaaataaaatagtaagaatgtatagccctgtcagcattttggacataagacaagggccaaaggaaccctttagagactatgtagaccggttctttaaaactttaagagctgaacaagctacacaagaagtaaaaggttggatgacagacaccttgttggtccaaaatgcaaacccagattgtaagaccattttaagagcattaggaccaggggcttcattagaagaaatggtgacagcatgtcaaggagtgggaggacctagccacaaagcaagagtgttggctgaggcaatgagccaatcacatagtaacataatgatgcagagaggcaattttaaaggccctaaaagaattgttaaatgcttcaactgtggcaaggaagggcacatagccagaaattgcagggcccctagaaaaagaggctgttggaaatgtgggcaagaaggacaccaaatgaaagactgtactgagaggcaggctaattttttagggaaaatttggccttcccacaaggggaggccagggaatttccttcaaaacaggccagagccaacagccccaccagcagagagcttcaggttcaaggagacaacccccgctccgaagcaggagtcgaaagacagggaacccttaacttccctcaaatcactctttggcagcgaccccttgtctcaataa

SEQ ID NO: 101 - DNA, 3011 bp, Human immunodeficiency virus type 1
  isolate=94IN476.104; gene=pol
ttttttagggaaaatttggccttcccacaaggggaggccagggaatttccttcaaaacaggccagagccaacagccccaccagcagagagcttcaggttcaaggagacaacccccgctccgaagcaggagtcgaaagacagggaacccttaacttccctcaaatcactctttggcagcgaccccttgtctcaataaaagtagggggccagataaaggaagctctcttagacacaggagcagatgatacagtattagaagaaatagctttgccaggaagatggaaaccaaaaatgataggaggaattggaggttttatcaaagtaagacagtatgatcaaatacttatagaaatttgtggaaaaaaggctataggtacagtattagtaggacctacacctgtcaacataattggaagagatatgttgactcagcttggatgcactctaaattttccaattagccccattgaaactgtaccagtaaaattaaagccaggaatggatggcccaaaggttaaacagtggccattgacagaagagaaaataaaagcattaacagaaatttgtaaagaaatggagaaggaaggaaaaattacaaaaattgggcctgaaaatccatataacactccagtatttgccataaaaaggaaggacagtactaagtggagaaaattagtagatttcagggagctcaataaaagaactcaagacttttgggaagttcaattaggaataccacacccagcaggtttaaaaaagaaaaaatcagtgacagtactggatgtgggggatgcatatttttcagttcctttagatgaaggcttcgggaaatatactgcattcaccatacctagtataaacaatgaaacaccagggattagatatcaatataatgtgcttccacagggatggaaaggatcaccagcaatattccagagtagcatgacaaaaatcttagagccctttagggcacgaaatccaaaaatagtcatctatcaatatatggatgacttgtatgtagggtctgacttagaaatagggcatcatagagcaaaaatagaggagttaagagcacatctattaaagtggggattcaccacaccagataagaaacatcagaaagaacccccatttctttggatggggtatgaactccatcctgacaaatggacagtacagcctataaagctgccagaaaaggatagctggactgtcaatgatatacagaagttagtgggaaaattaaactgggcaagtcagatttacccagggattaaagtgaggcaactttgtaaactccttaggggggccaaagcactaacagacatagtaccactaactgaagaagcagaattagaattagcagagaacagggaaattctaaaagagccagtacatggagtatattatgacccatcaaaagacttaatagctgaaatacagaaacaggggcatgaccaatggacatatcaaatttaccaagaaccattcaaaaatctgaaaacagggaagtatgcaaaaatgaggactgctcacactaatgatgtaaaacagttaacagaggcagtgcaaaaaatagccatagaaagcatagtaatatgggaaagacccctaaatttagactacccatccaaaaagaaacgtgggagacatggtggacagactattggcaggccacctggattcctgattgggagtttgttaatacccctcccctagtaaaattatggtaccagctagaaaaagaacccatagtaggagcagaaactttctatgtagatggagcagctaatagggaaactaaagtaggaaaagcagggtatgttactgacagaggaaggcagaaaattgtttctttaactgaaacaacaaatcagaagactgaattgcaagcaattcagctagctttgcaagattcaggaacagaagtaaacatagtaacagactcacagtatgcattaggaatcattcaagcacaaccagataaaagtgaatcagagttagtcaaccaaataatagaacaattaataaacaaagaaagagtctatctgtcatgggtaccagcacataaaggaattggagggaatgaacaagtagatagattagtaagtagtggaattaggaaagtactgtttctagatgggatagataaggctcaagaagatcatgaaaagtatcacagcaattggagagcaatggctaatgagtttaatctgccacccatagtagcaaaagaaatagtagctagctgtgataaatgccagctaaaaggggaagccatgcatggacaagtagaccgtagcccagggatatggcaattagattgtacacatctagaaggaaaaatcatcctggtagcagtccatgtagccagtggctacatagaagcagaggttatcccagcagaaacaggacaagaaacagcatactatatactaaaattagcaggaagatggccagtcaaagtaatacatacagacaatggtagtaatttcaccagtgctgcagttaaggcagcctgttggtgggcaggtatccaacaggaatttggaattccctacaatccccaaagccagggagtagtagaatccatgaataaagaattaaagaaaattatagggcaggtaagagaacaagctgagcaccttaagacagcagtacaaatggcagtattcattcacaattttaaaagaaaaggggggattggggggtacagtgcaggggaaagaacaatagacataatagcaacagacatacaaactaaagaattacaaaaccaaattacaaaaattcaaaattttcgggtttattacagagacagcagagaccccatttggaaaggaccagccaaactgctctggaaaggtgaaggggcagtagtaatacaagataatagtgacataaaggtagtgccaaggaggaaagcaaaaattattagggattatggaaaacagatggcaggtgctgattgtgtggcaggtagacaggatgaggatcagaacatggaatag

SEQ ID NO: 102 - DNA, 579 bp, Human immunodeficiency virus type 1
  isolate=94IN476.104; gene=vif
atggaaaacagatggcaggtgctgattgtgtggcaggtagacaggatgaggatcagaacatggaatagtttagtaaaacaccatatgtatgtttcaagaagagctagtggatggttttacagacatcattatgaaagcagacatccaaaagtaagtgcagaagtacacatcccattaggagatgctagattagtaataaaaacatattggggtttacaaacaggagaaagagattggcatttgggtcatggcgtctccatagaatggagattgggaagatatagcacacaagtagaacctggcctggcagaccagctaatccatatgcattattttgattgttttgcagactctgccataagaaaagccatattaggacacatagttatttctaggtgtgattatcaagcaggacataataaggtaggatctctacaatacttggcactgacagcattgataaaaccaaaaaagagaaagccacctctgcctagtgttaagaaattagtagaggatagatggaacaatccccagaagaccagggaccacagagggaaccatacaatgaatggacactag

SEQ ID NO: 103 - DNA, 291 bp, Human immunodeficiency virus type 1
  isolate=94IN476.104; gene=vpr
atggaacaatccccagaagaccagggaccacagagggaaccatacaatgaatggacactagagcttctagaggaactcaagcaggaagctgtcagacactttcctagaccttagcttcatagcttaggacaatatatctatgaaacatatggggatgcttggacaggagtcgaagctttaataagaacactgcaacaattactgtttattcatttcagaattgggtgccagcatagcagaataggcattttacaacggagaagagcaagaaatggagccagtagatcctaa

SEQ ID NO: 104 - DNA, 2633 bp, Human immunodeficiency virus type 1
  isolate=94IN476.104; gene=tat
atggagccagtagatcctaacctagagccctggaaccatccaggaagtcagcctaaaactgcttgtaatacatgctattgtaaacactgtagctaccattgtctagtttgctttcagacaaaaggcttaggcatttcctatggcaggaagaagcggagacagcgacgcagcgctcctccaagcagtgaggatcatcaaaatcttatatcaaagcagtaagtatatgtaatggtgaatttattagaaagagtagattatagattaggagtaggagcattaatagtagcattaatcttagcaataattgtgtggaccatagcatatctagaatataggaaattgttaagacaaagaaaaataaacaggttaattgaaagaattagggaaagagtagaagacagtggcaatgagagtgagggggatactgaggaattgtcaacactggtggatatggggaatcttaggcttttggatgctaatgatttataatgtagtagggaacttgtgggtcacagtctattatggggtacctgtgtggaaagaagcaaaaactactttattctgtgcatcagatgctaaagcttatgagaaggaggtgcataatatctgggctacacatgcctgtgtacccacagaccccaacccacaagagatggatttagtaaatgtaacagaaaattttaacatgtggaaaaatgacatggtggatcagatgcatgaggatgtaatcagtttatgggatcaaagcctaaagccatgtgtaaagttgaccccactctgtgtcactttaaactgtagtaaggttaccaataatgctacttacaataatactgatgatataaaaaattgctcttttaatgcaaccacagaaataagagacaagaaacgcaaagagtatgcactgttttatagactcgatatagtaccactaaatgagaataagaacagctctagtaactatagtgagtacatattaataaattgtaatacctcaaccataacacaagcctgtccaaaggtctcttttgacccaattcctatacattattgtgctccagctggttttgcgattctaaagtgtaaagatgagacattcaatgggacaggaccatgcaaggaggtcagtacagtacaatgtacacatggaattaagccagtggtatcaactcaactactgttaaatggtagcacagcagaaaaagagataataactagatctgaaaatataacagacaatgcaaaaactataatagtacatcttaatgaatccataaaaattgtatgtacaagacccaacaataacacaagaaaaagtataaggatagggccaggacaagcattctatgcaacaaacggcataataggagacataagacaagcacattgtaacattagtgaatctaactggactaaaactttacaagaggtaggaaaaaaattagcaaagcacttccctaataaaacaataagtttcaaccaatcctcaggaggggacctagaaattgtaacacatagctttaattgtggaggagaattcttttattgtaatacatcaagactgtttaacggtacatacaatggtacagacatgcctacatacaatggtacaaattccagttcagacatcatcatgcttccatgcagaataaggcaatttataaacatttggcagaaggtaggacgagcaatgtatgcccctcccattgaaggaaacataacatgtgaatcaaatatcacaggactactattagtacgtgatggaggcgacacaaatagtagcacagagatattcagacctggaggaggagatatgagggacaattggagaagtgaattatataaatataaagtggtagaaattaagccattaggaatagcacctactgaagcaaaaaggagagtggtggagagagaaaaaagagcagtgggaataggagctgtgttccttgggttcttgggagtagcaggaagcactatgggcgcggcgtcaatgacgctgacggtacaggccagacaattgttgtctggtatagtgcaacagcaaagcaatttgctgaaggctatagaggcgcaacagcatatgttgcaactcacagtctggggcattaagcagctccagacaagagtcttggctatagagagatacctaaaggatcaacagctcctagggatttggggctgctctggaaaagtcatctgccccactgctgtgccttggaactccagctggagtaataaatcaaaagatgatatttggaataacatgacctggatgcagtgggataaagagattagtaattacacaaacacaatataccggttgcttgaagaatcgcaaatccagcaggaacaaaatggaaaagatttattagcattggacagttggcaaaatctgtggaattggtttagcataacaaaatggctgtggtatataaaaatattcataattatagtaggaggcttgataggtttgagaataatttttgctgtgctatctatagtaaatagagttaggcagggatactcacctttgtcgttgcagacccttaccccagacccgagggaacccgacaggctcagaggaatcgaagaagaaggtggagagcaagacaaagacagatccattcgattag

SEQ ID NO: 105 - DNA, 2651 bp, Human immunodeficiency virus type 1
  isolate=94IN476.104; gene=rev
atggcaggaagaagcggagacagcgacgcagcgctcctccaagcagtgaggatcatcaaaatcttatatcaaagcagtaagtatatgtaatggtgaatttattagaaagagtagattatagattaggagtaggagcattaatagtagcattaatcttagcaataattgtgtggaccatagcatatctagaatataggaaattgttaagacaaagaaaaataaacaggttaattgaaagaattagggaaagagtagaagacagtggcaatgagagtgagggggatactgaggaattgtcaacactggtggatatggggaatcttaggcttttggatgctaatgatttataatgtagtagggaacttgtgggtcacagtctattatggggtacctgtgtggaaagaagcaaaaactactttattctgtgcatcagatgctaaagcttatgagaaggaggtgcataatatctgggctacacatgcctgtgtacccacagaccccaacccacaagagatggatttagtaaatgtaacagaaaattttaacatgtggaaaaatgacatggtggatcagatgcatgaggatgtaatcagtttatgggatcaaagcctaaagccatgtgtaaagttgaccccactctgtgtcactttaaactgtagtaaggttaccaataatgctacttacaataatactgatgatataaaaaattgctcttttaatgcaaccacagaaataagagacaagaaacgcaaagagtatgcactgttttatagactcgatatagtaccactaaatgagaataagaacagctctagtaactatagtgagtacatattaataaattgtaatacctcaaccataacacaagcctgtccaaaggtctcttttgacccaattcctatacattattgtgctccagctggttttgcgattctaaagtgtaaagatgagacattcaatgggacaggaccatgcaaggaggtcagtacagtacaatgtacacatggaattaagccagtggtatcaactcaactactgttaaatggtagcacagcagaaaaagagataataactagatctgaaaatataacagacaatgcaaaaactataatagtacatcttaatgaatccataaaaattgtatgtacaagacccaacaataacacaagaaaaagtataaggatagggccaggacaagcattctatgcaacaaacggcataataggagacataagacaagcacattgtaacattagtgaatctaactggactaaaactttacaagaggtaggaaaaaaattagcaaagcacttccctaataaaacaataagtttcaaccaatcctcaggaggggacctagaaattgtaacacatagctttaattgtggaggagaattcttttattgtaatacatcaagactgtttaacggtacatacaatggtacagacatgcctacatacaatggtacaaattccagttcagacatcatcatgcttccatgcagaataaggcaatttataaacatttggcagaaggtaggacgagcaatgtatgcccctcccattgaaggaaacataacatgtgaatcaaatatcacaggactactattagtacgtgatggaggcgacacaaatagtagcacagagatattcagacctggaggaggagatatgagggacaattggagaagtgaattatataaatataaagtggtagaaattaagccattaggaatagcacctactgaagcaaaaaggagagtggtggagagagaaaaaagagcagtgggaataggagctgtgttccttgggttcttgggagtagcaggaagcactatgggcgcggcgtcaatgacgctgacggtacaggccagacaattgttgtctggtatagtgcaacagcaaagcaatttgctgaaggctatagaggcgcaacagcatatgttgcaactcacagtctggggcattaagcagctccagacaagagtcttggctatagagagatacctaaaggatcaacagctcctagggatttggggctgctctggaaaagtcatctgccccactgctgtgccttggaactccagctggagtaataaatcaaaagatgatatttggaataacatgacctggatgcagtgggataaagagattagtaattacacaaacacaatataccggttgcttgaagaatcgcaaatccagcaggaacaaaatggaaaagatttattagcattggacagttggcaaaatctgtggaattggtttagcataacaaaatggctgtggtatataaaaatattcataattatagtaggaggcttgataggtttgagaataatttttgctgtgctatctatagtaaatagagttaggcagggatactcacctttgtcgttgcagacccttaccccagacccgagggaacccgacaggctcagaggaatcgaagaagaaggtggagagcaagacaaagacagatccattcgattagtgaacggattcttagcacttgcctgggacgatctacggagcctgtgcctcttcagttgccaccgattgagagacttcatattggttgcagcgagagcggtggaacttctgggacgcagcagtctcaggggactacagagggggtgggaagcccttaa

SEQ ID NO: 106 - DNA, 261 bp, Human immunodeficiency virus type 1
  isolate=94IN476.104; gene=vpu
atggtgaatttattagaaagagtagattatagattaggagtaggagcattaatagtagcattaatcttagcaataattgtgtggaccatagcatatctagaatataggaaattgttaagacaaagaaaaataaacaggttaattgaaagaattagggaaagagtagaagacagtggcaatgagagtgagggggatactgaggaattgtcaacactggtggatatggggaatcttaggcttttggatgctaatgatttataa

SEQ ID NO: 107 - DNA, 2574 bp, Human immunodeficiency virus type 1
  isolate=94IN476.104; gene=env
atgagagtgagggggatactgaggaattgtcaacactggtggatatggggaatcttaggcttttggatgctaatgatttataatgtagtagggaacttgtgggtcacagtctattatggggtacctgtgtggaaagaagcaaaaactactttattctgtgcatcagatgctaaagcttatgagaaggaggtgcataatatctgggctacacatgcctgtgtacccacagaccccaacccacaagagatggatttagtaaatgtaacagaaaattttaacatgtggaaaaatgacatggtggatcagatgcatgaggatgtaatcagtttatgggatcaaagcctaaagccatgtgtaaagttgaccccactctgtgtcactttaaactgtagtaaggttaccaataatgctacttacaataatactgatgatataaaaaattgctcttttaatgcaaccacagaaataagagacaagaaacgcaaagagtatgcactgttttatagactcgatatagtaccactaaatgagaataagaacagctctagtaactatagtgagtacatattaataaattgtaatacctcaaccataacacaagcctgtccaaaggtctcttttgacccaattcctatacattattgtgctccagctggttttgcgattctaaagtgtaaagatgagacattcaatgggacaggaccatgcaaggaggtcagtacagtacaatgtacacatggaattaagccagtggtatcaactcaactactgttaaatggtagcacagcagaaaaagagataataactagatctgaaaatataacagacaatgcaaaaactataatagtacatcttaatgaatccataaaaattgtatgtacaagacccaacaataacacaagaaaaagtataaggatagggccaggacaagcattctatgcaacaaacggcataataggagacataagacaagcacattgtaacattagtgaatctaactggactaaaactttacaagaggtaggaaaaaaattagcaaagcacttccctaataaaacaataagtttcaaccaatcctcaggaggggacctagaaattgtaacacatagctttaattgtggaggagaattcttttattgtaatacatcaagactgtttaacggtacatacaatggtacagacatgcctacatacaatggtacaaattccagttcagacatcatcatgcttccatgcagaataaggcaatttataaacatttggcagaaggtaggacgagcaatgtatgcccctcccattgaaggaaacataacatgtgaatcaaatatcacaggactactattagtacgtgatggaggcgacacaaatagtagcacagagatattcagacctggaggaggagatatgagggacaattggagaagtgaattatataaatataaagtggtagaaattaagccattaggaatagcacctactgaagcaaaaaggagagtggtggagagagaaaaaagagcagtgggaataggagctgtgttccttgggttcttgggagtagcaggaagcactatgggcgcggcgtcaatgacgctgacggtacaggccagacaattgttgtctggtatagtgcaacagcaaagcaatttgctgaaggctatagaggcgcaacagcatatgttgcaactcacagtctggggcattaagcagctccagacaagagtcttggctatagagagatacctaaaggatcaacagctcctagggatttggggctgctctggaaaagtcatctgccccactgctgtgccttggaactccagctggagtaataaatcaaaagatgatatttggaataacatgacctggatgcagtgggataaagagattagtaattacacaaacacaatataccggttgcttgaagaatcgcaaatccagcaggaacaaaatggaaaagatttattagcattggacagttggcaaaatctgtggaattggtttagcataacaaaatggctgtggtatataaaaatattcataattatagtaggaggcttgataggtttgagaataatttttgctgtgctatctatagtaaatagagttaggcagggatactcacctttgtcgttgcagacccttaccccagacccgagggaacccgacaggctcagaggaatcgaagaagaaggtggagagcaagacaaagacagatccattcgattagtgaacggattcttagcacttgcctgggacgatctacggagcctgtgcctcttcagttgccaccgattgagagacttcatattggttgcagcgagagcggtggaacttctgggacgcagcagtctcaggggactacagagggggtgggaagcccttaaatatctgggaagtcttgtgcagtattggggtctggaactaaaaaagagtgctattagtctgcttgataccatagcaataacaatagctgagggaacagataggattatagaatttacacaaagaatttgcagagctatccgcaacatacctagaagaataagacagggttttgaagcagctttgctataa

SEQ ID NO: 108 - DNA, 624 bp, Human immunodeficiency virus type 1
  isolate=94IN476.104; gene=nef
atggggagcaagatgtcaaaaagcagaatagttggatggcctgaggtaagagaaagaatgaggagaactgagccagcagcagagggagtaggagcagcatctcaagacttagctaaacatggagcacttacaaccagcaacacaccaagcaataatgctgctggtgcctggctgcaagcgcaagaggaggaagaagaagtaggctttccagtcagacctcaggtgcctttaagaccaatgacttataaaggagcattcgatctcgccttctttttaaaagaaaaggggggactggatgggttaatttactctaagaaaaggcatgaaatccttgatttatgggtttataacacacaaggctacttccctgattggcaaaactacacaccaggaccaggggtcagatatccactgacctttggatggtgctacaagctagtaccagttgacccaagtgtagtagaagaggccaacaaaggagaaaacaactgtttgctacaccctatgagccaacatggaatggatgatgaagatggagaagtattaaagtggcagtttgacagcagcctagcacgcagacacatagcccgcgagctacatccggagtattacaaagactgctga

SEQ ID NO: 109 - DNA, 17 bp, artificial sequence
  Upstream primer UP1A spanning tRNA primer binding state
agtggcgcccgaacagg

SEQ ID NO: 110 - DNA, 22 bp, artificial sequence
  Downstream primer Low2 spanning the R/U5 junction in the 3' long terminal repeat
tgaggcttaagcagtgggtttc

SEQ ID NO: 111 - DNA, 28 bp, artificial sequence
  Upstream UP1AMlu1 primer containing Mlu1 restriction site
tctctacgcgtggcgcccgaacagggac

SEQ ID NO: 112 - DNA, 35 bp, artificial sequence
  Downstream Low1Mlu1 primer containing Mlu1 restriction site
accagacgcgtacaacagacgggcacacactactt

SEQ ID NO: 113 - protein, 29 aa, artificial sequence
  Xaa=unknown 2, 8, 9: Consensus sequence of deduced Tat gene
PXPQTQGXXTGPKESKKKVESKTETDRFD

SEQ ID NO: 114 - protein, 29 aa, artificial sequence
  Xaa=unknown 2, 28: Consensus sequence of deduced Tat gene
PXSQPRGDPTGPKESKKKVERETETDPXD

SEQ ID NO: 115 - protein, 29 aa, artificial sequence
  Consensus sequence of deduced Tat gene
PLPQTRGDPTGSEESKKKVESKTETDPFD

SEQ ID NO: 116 - protein, 14 aa, artificial sequence
  Consensus sequence of deduced Tat gene
PSSQPRGDPTGPKE

SEQ ID NO: 117 - protein, 27 aa, artificial sequence
  isolate=ELI; gene=tat
PSSQPRGDPTGPKEQKKKVESETETDP

SEQ ID NO: 118 - protein, 14 aa, artificial sequence
  isolate=NDK; gene=tat
PSSQSRGDPTGPKK

SEQ ID NO: 119 - protein, 30 aa, artificial sequence
  isolate=92UG024.2; gene=tat
PSSQPRGDPTGPEKQKKKVESKTEADPFDC

SEQ ID NO: 120 - protein, 14 aa, artificial sequence
  isolate=UG274A2; gene=tat
PSSQPRGNPTGPKK

SEQ ID NO: 121 - protein, 14 aa, artificial sequence
  isolate=SE365A2; gene=tat
PSSQHRGDPTGPKE

SEQ ID NO: 122 - protein, 30 aa, artificial sequence
  isolate=93ZR001.3; gene=tat
PLSQPRGDPTGPKEQKKKVESQTEADRFDC

SEQ ID NO: 123 - protein, 29 aa, artificial sequence
  isolate=UG266A2; gene=tat
PSSQPRGDPTGPKEQKKKVESKTEVDPFD

SEQ ID NO: 124 - protein, 15 aa, artificial sequence
  isolate=MAL; gene=tat
PSSQHRGDHPTGPKE

SEQ ID NO: 125 - protein, 14 aa, artificial sequence
  isolate=K124A2; gene=tat
PSSQPRGDQTGPKE

SEQ ID NO: 126 - protein, 14 aa, artificial sequence
  isolate=84ZR085.1; gene=tat
PSSQPRGDPTGQKE

SEQ ID NO: 127 - protein, 14 aa, artificial sequence
  isolate=94UG114.1; gene=tat
PSSQPRGNPTGPKE

SEQ ID NO: 128 - protein, 29 aa, artificial sequence
  Consenus sequence of deduced Tat gene
PLPIIRGNPTDPKESKKEVASKAETDPCD

SEQ ID NO: 129 - protein, 29 aa, artificial sequence
  Consenus sequence of deduced Tat gene
PISQARGNPTGPKESKKEVESKAKTDPCA

SEQ ID NO: 130 - protein, 29 aa, artificial sequence
  Xaa=unknown 20: Consenus sequence of deduced Tat gene
PLPTTRGNPTGPKESKKEVXSKTETDPFD

SEQ ID NO: 131 - protein, 27 aa, artificial sequence
  Consenus sequence of deduced Tat gene
PLSRTHGDPTGPKEQKKEVASKTETDP

SEQ ID NO: 132 - protein, 97 aa, artificial sequence
  Xaa=unknown 4, 8, 52, 74: Consenus sequence of deduced Rev gene
PYPXPKGXRQARKNRRRRWRARQRQIDSISERILSTCLGRPAEPVPLQLPPXERLHLDCSEDCGTSGTQQSQGXETGVGRPQVSVESSVILGSGTKN

SEQ ID NO: 133 - protein, 90 aa, artificial sequence
  Xaa=unknown 31: Consenus sequence of deduced Rev gene
PPPSPEGTRQARRNRRRRWRERQRQIRSISXWILSTYLGRSAEPVPLQLPPLERLTLDCSEDCGTSGTQGVGSPQILVESPAVLESGTKE

SEQ ID NO: 134 - protein, 81 aa, artificial sequence
  Xaa=unknown 13, 63: Consenus sequence of deduced Rev gene
PYPKPEGTRQARXNRRRRWRARQRQIHSISERILSTCLGRPAEPVPLQLPPIERLHIDCSESXGTSGTQQSQGTTEGVGSP

SEQ ID NO: 135 - protein, 81 aa, artificial sequence
  isolate=93MW959.18; gene=rev
PYPKPEGTRQARKNRRRRWRARQRQIHSISERILSTCLGRPAEPVPLQLPPIERLHIGCSESSGTSGTQQSQGTTEGVGRP

SEQ ID NO: 136 - protein, 81 aa, artificial sequence
  isolate=93MW960.3; gene=rev
PYPKPEGTRQARKNRRRRWRARQRQLHSISERILSTFLGRPAEPVPLQLPPIERLTIGCSESGGTPGTQQSQGTTEGVGSP

SEQ ID NO: 137 - protein, 81 aa, artificial sequence
  isolate=93MW965.26; gene=rev
PYPKPEGTRQARRNRRRRWRARQRQIHSIGERILATCLGRPAEPVPLQLPPIERLHIDCSESSGTSGTQQSQGTAEGVGSP

SEQ ID NO: 138 - protein, 81 aa, artificial sequence
  isolate=UG268A2; gene=rev
PYPNPEGTRQARRNRRRRWRARQRQIREINQRILSTCLGRSAEPVPLQLPPLERLTIDCSESSGTSGTQQSQGTTEGVGSP

SEQ ID NO: 139 - protein, 81 aa, artificial sequence
  isolate=SM145A; gene=rev
PYPKPEGTRQARKNRRRRWRARQRQIHSISERILSTCLGRPTEPVSLQLPPIERLHIGGSESGGTSGTQQSQGTTERVGSP

SEQ ID NO: 140 - protein, 81 aa, artificial sequence
  isolate=ZAM18A; gene=rev
PYPEPKGTRQARKNRRRRWRARQRQIHSLSGRILSTFLGRPAEPVPFQLPPIERLHIDCSESSGTSGTQQSQGTTEGVGSP

SEQ ID NO: 141 - protein, 82 aa, artificial sequence
  isolate=ZAM20A; gene=rev
PYPEHQGGTRQARKNRRRRWRARQRQIHSISERILSTCLGRPAEPVPFQLPPIERLHIDCSESGGTSGTEQSQGTTEGVGSP

SEQ ID NO: 142 - protein, 74 aa, artificial sequence
  isolate=DJ259A; gene=rev
PYPKPEGTRQARRNRRRRWRARQRQIDSISERILSACLGRPAEPVPLQLPPIERLNLDCSESGGTAGTEGVGNP

SEQ ID NO: 143 - protein, 74 aa, artificial sequence
  isolate=DJ373A; gene=rev
PYPEPKGTRQAQRNRRRRWRARQRQIHSISERILSTCLGRPAEPVPFQLPPIERLNLDCSESGGTSGTEGVGNP

SEQ ID NO: 144 - protein, 81 aa, artificial sequence
  isolate=C2220; gene=rev
PYPTPEGTRQARRNRRRRWRARQRQIHTLSERILSNFLGRPAEPVPLQLPPLERLNLDCSEDSGTSGTQQSQGTTEGVGNP

SEQ ID NO: 145 - protein, 81 aa, artificial sequence
  isolate=SE364A; gene=rev
PYPKPEGTRQARKNRRRRWRARQRQIHSISERILVHCLGRPAEPVPLQLPPIERLHIDCSESSGTPDTEQSQGTTEGVGNP

SEQ ID NO: 146 - protein, 81 aa, artificial sequence
  isolate=92BR025.8; gene=rev
PYPKPEGTRQARRNRRRRWRARQRQIHSISERILSTCVGRPAEPVPFQLPPIERLNINCSESGGTSGTQQPQGNTERVGNP

SEQ ID NO: 147 - protein, 81 aa, artificial sequence
  isolate=94IN476.104; gene=rev
PYPRPEGTRQAQRNRRRRWRARQRQIHSISERILSTCLGRSTEPVPLQLPPIERLHIGCSESGGTSGTQQPQGNTERVGNP

SEQ ID NO: 148 - protein, 81 aa, artificial sequence
  isolate=96ZM651.8; gene=rev
PYPEPKGTRQARKNRRRRWRARQREIRAISERILSTCLGRPTEPVPLQLPPIERLHIGDSESGGTSGTQQSQGTTEGVGSP

SEQ ID NO: 149 - protein, 81 aa, artificial sequence
  isolate=96ZM751.3; gene=rev
PYPNPEGTRQARKNRRRRWRARQRQINSISERILSTCLGRPPEPVPFQLPPLERLHIDCSESGGASETQQSQGTTEGVGSP

SEQ ID NO: 150 - protein, 90 aa, artificial sequence
  Xaa=unknown 60: Consenus sequence of deduced Rev gene
PPPSPEGTRQARRNRRRRWRARQRQIHSIGERILSTYLGRPEEPVPLQLPPLERLNLNCXEDCGTSGTQGVGSPQISVESPAVLDSGTEE

SEQ ID NO: 151 - protein, 97 aa, artificial sequence
  Xaa=unknown 2: Consenus sequence of deduced Rev gene
PXPSSEGTRQTRKNRRRRWRARQRQIRAISERILSTCLGRSTEPVPLQLPPLERLHLDCSEDCGTSGTQQSQGTETGVGRPQISGESSVILGPGTKN

SEQ ID NO: 152 - protein, 90 aa, artificial sequence
  Xaa=unknown 64: Consenus sequence of deduced Rev gene
PYPKPEGTRQARRNRRRRWRARQRQIREISERILSSCLGRPEEPVPLQLPPLERLHINCSEDCXQGAEEGVGSPQTSGESHAVLGSGTKE

SEQ ID NO: 153 - protein, 97 aa, artificial sequence
  Xaa=unknown 13, 28, 36, 95: Consenus sequence of deduced Rev gene
PYPPPEGTRQARXNRRRRWRARQRQIHXISERILSXCLGRPAEPVPLQLPPLERLHLDCSEDSGTSGTQQSQGTETGVGGPQISVESSVVLGSGXKE

SEQ ID NO: 154 - protein, 89 aa, artificial sequence
  Consenus sequence of deduced Rev gene
PCPEPTGTRQARRNRRRRWRARQRQIREISERILTSCLGRPPEPVTLQLPPLERLTLNCSEDCGTSGEKGEGSPQISLESSTILGTGKE

SEQ ID NO: 155 - protein, 28 aa, artificial sequence
  Xaa=unknown 2, 3, 7, 18: Consenus sequence of deduced Vpu gene
MXXLEIXAIVGLVVALIXAIVVWTIVGI

SEQ ID NO: 156 - protein, 28 aa, artificial sequence
  Xaa=unknown 7, 27: Consenus sequence of deduced Vpu gene
MQSLQIXAIVALVVAAIIAIVVWTIVXI

SEQ ID NO: 157 - protein, 33 aa, artificial sequence
  Xaa=unknown 2, 13: Consenus sequence of deduced Vpu gene
MXDLLAKVDYRLXVGALIVALIIAIVVWTIAYI

SEQ ID NO: 158 - protein, 33 aa, artificial sequence
  isolate=92BR025.8; gene=vpu
MLELIGRIDYRLGVGALIVALIIVIIVWTIAYI

SEQ ID NO: 159 - protein, 33 aa, artificial sequence
  isolate=C2220; gene=vpu
MVDLLAKVDYRIVIVAFIVALIIAIVVWTIAYI

SEQ ID NO: 160 - protein, 33 aa, artificial sequence
  isolate=SM145; gene=vpu
MLNLLAGVDYRIAIGAFSVALIIAIVVWTIVYI

SEQ ID NO: 161 - protein, 33 aa, artificial sequence
  isolate=UG268; gene=vpu
MLNLLAGVDYRIGIGALLIALIIAIVVWIIVYI

SEQ ID NO: 162 - protein, 33 aa, artificial sequence
  isolate=DJ259; gene=vpu
MIDLPAKVDYRLAVGALIVALIIAIVVWTIVYI

SEQ ID NO: 163 - protein, 33 aa, artificial sequence
  isolate=DJ373; gene=vpu
MIDLLAKVDYRLAVAAFIIAFIIAIVVWTIAYI

SEQ ID NO: 164 - protein, 33 aa, artificial sequence
  isolate=SE364; gene=vpu
MVDLLAKVDYRLGVGALIVALIIAIIVWIIAYI

SEQ ID NO: 165 - protein, 33 aa, artificial sequence
  isolate=94IN476.104; gene=vpu
MVNLLERVDYRLGVGALIVALILAIIVWTIAYL

SEQ ID NO: 166 - protein, 33 aa, artificial sequence
  isolate=96ZM651.8; gene=vpu
MLDLLARVNYRVGVGALIVALLIAIVVWTIAYI

SEQ ID NO: 167 - protein, 33 aa, artificial sequence
  isolate=96ZM751.3; gene=vpu
MLNLEARVDYRIGVGALIAALIIAIAVWIIVYI

SEQ ID NO: 168 - protein, 28 aa, artificial sequence
  Xaa=unknown 5: Consenus sequence of deduced Vpu gene
MQPLXILAIAALVVALIIAIVVWTIVFI

SEQ ID NO: 169 - protein, 28 aa, artificial sequence
  Xaa=unknown 8, 10: Consenus sequence of deduced Vpu gene
MSYLLAIXIXALIVALIIAIVVWTIAYI

SEQ ID NO: 170 - protein, 28 aa, artificial sequence
  Xaa=unknown 3, 7, 10, 27: Consenus sequence of deduced Vpu gene
MQXLEIXAIXGLVVAFIAAIVVWSIVXI

SEQ ID NO: 171 - protein, 27 aa, artificial sequence
  Consenus sequence of deduced Vpu gene
MYILGLGIGALVVTFIIAVIVWTIVYI

SEQ ID NO: 172 - protein, 492 aa, Human immunodeficiency virus type 1
  isolate=93BR20.1; gene=gag
MGARASVLSGGKLDAWEKIRLRPGGKKKYRLKHLVWASRELERFALDPGLLETSEGCRKIIGQLQPSLQTGSEELKSLYNTIAVLYYVHQKVEVKDTKEALEKLEEEQNKGRQKTQQATAEKGVSQNYPIVQNLQGQMVHQSLSPRTLNAWVKVIEEKAFSPEVIPMFSALSEGATPQDLNTMLNTVGGHQAAMQMLKDTINEEAAEWDRLHPTQAGPIPPGQIREPRGSDIAGTTSTLQEQIQWMTGNPPVPVGEMYKRWIILGLNKIVRMYSPVGILDIRQGPKEPFRDYVDRFFKTLRAEQATQEVKGWMTDTLLVQNANPDCKTILKALGPGATLEEMMTACQGVGGPSHKARVLAEAMSQATNTAIMMQKSNFKGQRRIVKCFNCGKEGHIAKNCRAPRKKGCWKCGREGHQMKDCTERQANFLGKIWPSNKGRPGNFIQNRPEPSAPPAESFRFGEETTPSPKQEQKDEGLYPPLASLKSLFGNDP

SEQ ID NO: 173 - protein, 497 aa, Human immunodeficiency virus type 1
  isolate=92NG083.2; gene=gag
VGARASVLSGGKLDSWEKIRLRPGGRKKYKLKHIVWASRELGRFALNRDLLETAEGCVQIMKQLQPALTGTEELRSLFNTVATLYCVHQKIEVKDTKEAPEEVEKIQKNSQQEIQQAAKNEGNSNPVSQNYPIVQNAQGQMIHQAISPRTLNAWVKVVEEKAFSPEVIPMFSALSEGATPQDLNTMLNTVGGHQAAMQMLKDTINDEAAEWDRIHPQQAGPIPPGQIREPSGSDIAGTTSTLQEQIRWMTSNPPIPVGEIYKRWIILGLNKIVRMYSPVSILDIRQGPKEPFRDYVDRFFKTLRAEQATQEVKGWMTDTLLVQNANPDCKTILRALGPGATLEEMMTACQGVGGPSHKARVLAEAMSQASGAAAAAIMMQKSNFKGPRRIIKCFNCGKEGHLARNCRAPRKKGCWKCGKEGHQMKECTERQANFLGKIWPSNKGRPGNFLQNRTEPTAPPAESFGFGEEIAPSPKQEPKEKELYPLTSLKSLFGSDP

SEQ ID NO: 174 - protein, 500 aa, Human immunodeficiency virus type 1
  isolate=90CF056.1; gene=gag
MGARASVLSGGKLDAWEKIRLRPGGKKKYRLKHLVWASRELERFALNPGLLETPEGCLQIIEQIQPAIKTGTEELKSLFNLVAVLYCVHRKIDVKDTKEALDKIEEIQNKSQQKTQQAAADKEKDNKVSQNYPIVQNAQGQMVHQAISPRTLNAWVKVVEEKAFSPEVIPMFSALSEGATPQDLNTMLNTVGGHQAAMQMLKDTINDEAAEWDRIHPQQAGPIPPGQIREPSGSDIAGTTSTLQEQIAWMTSNPAIPVGDIYKRWIILGLNKIVRMYSPVSILDIKQGPKEPFRDYVDRFFKTLRAEQATQDVKNWMTETLLVQNANPDCKTILRALGQGASIEEMMTACQGVGGPSHKARVLAEAMSQVTNTNTAIMMQKGNFKGQRKFVKCFNCGKEGHIARNCRAPRKKGCWKCGREGHQMKECTERQANFLGKIWPSSKGRPGNFLQSRPEPTAPPAESFGFGEEMTPSPKQEQLKDKEPPLASLRSLFGSDPLLQ

SEQ ID NO: 175 - protein, 494 aa, Human immunodeficiency virus type 1
  isolate=92RW009.6; gene=gag
MGARASILRGGKLDAWEKIKLKPGGKKTYMMKHLVWASRELERFALNPDLLETPEGCKQIMRQLQPALQTGTDELRSLYNTVATLYCVHQKIDVKDTKEALDKIEEEQNKSQQKTQQAEAADKGKVSQNYPIVQNAQGQMVHQAISPRTLNAWVKVIEEKAFSQEVIPMFTALSEGATPQDLNTMLNTVGGHQAAMQMLKDTINEEAAEWDRVHPVQAGPVAPGQIREPRGSDIAGTTSTLQEQIAWMTNNPPIPVGEIYKRWIILGLNKIVRMYSPVSILDIKQGPKEPFRDYVDRFFKTLRAEQASQDVKNWMTDTLLVQNANPDCKTILRALGPGASLEEMMTACQGVGGPGHKARVLAEAMSQVQQPNIMMQRGNFKGQRRIIKCFNCGKEGHLARNCRAPRKKGCWKCGKEGHQMKDCTERQANFLGKIWPSNKGRPGNFPQSRLEPTAPPAENFGMGEEIASPLKQEQKDREPLISLKSLFGNDPLSQ

SEQ ID NO: 176 - protein, 497 aa, Human immunodeficiency virus type 1
  isolate=92NG003.1; gene=gag
MGARASVLSGGKLDAWEKIRLRPGGKKKYRMKHLVWASRELERFALNPDLLETTEGCQQIMRQLQPSLQTGTEEIKSLFNTVATLYCVHQRIEVKDTKEALEEVEKIQKNSQQETQKAAMGKGNSSQVSQNYPIVQNAQGQVVHQPISPRTLNAWVKVIEEKNFSPEVIPMFTALSEGATPQDLNTMLNTVGGHQAAMQMLKDSINEEAAEWDRLHPQQAGPIPPGQIREPRGSDIAGTTSTLQEQITWMTSNPPIPVGEIYKRWIILGLNKIVRMYSPVSILDIKQGPKEPFRDYVDRFFKTLRAEQATQEVKNWMTDTLLVQNANPDCKTILRALGAGATLEEMLTACQGVGGPSHKARVLAEAMSRATGTSAAIMMQKNNFKGPRRGIKCFNCGKEGHLARNCRAPRKKGCWKCGKEGHQMKDCTERQANFLGKIWPSNKGRPGNFLQNRPEPTAPPAESFGFGEEIAPSLKQEPREKESPPLTSLKSLFGNDP

SEQ ID NO: 177 - protein, 500 aa, Human immunodeficiency virus type 1
  Xaa=unknown 110: isolate=93BR029.4; gene=gag
MGARASVISGGELDKWEKIRLRPGGHKKYRLKHIVWASRELERFAVNPGLLETSEGCRQILEQLQPALKTGSEELRSLYNTVATLYCVHQKIDVKDTKEALEKIEEEQNXSKKKAQQAAANTGNNSQVSQNYPIVQNLQGQMVHQAISPRTLNAWVKVVEEKAFSPEVIPMFSALSEGATPQDLNTMLNTVGGHQAAMQMLKETINEEAAEWDRVHPVHAGPIPPGQMREPRGSDIAGTTSTLQEQIQWMTSNPPVPVGEIYKRWIILGLNKIVRMYSPTSILGIRQGPKEPFRDYVDRFYKTLRAEQTSQDVKNWMTETLLVQNANPDCKTILKALGPAATLEEMMTACQGVGGPGHKARVLAEAMSQVTNSGTIMMQRGNFRNQRKTIKCFNCGKEGHIAKNCRAPRKKGCWKCGKEGHQMKDCTERQANFLGKIWPSHKGRPGNFLQSRPEPTAPPAESFRFGEEVTTPSQKQEPIDKEMYPLASLRSLFGNDPSSQ

SEQ ID NO: 178 - protein, 500 aa, Human immunodeficiency virus type 1
  isolate=94CY032.3; gene=gag
MGARASVLSGGKLDAWERIRLRPGGKKKYRLKHLVWASRELERFALNPGLLETAEGCQQLMEQLQSTLKTGSEELRSLYNTITTLWCVHQRIDVQDTKEALDKIEEIQSKSKQKTQQAAAAAGGSSNVSQNYPIVQNAQGQMVHQSISPRTLNAWVKVIEEKAFSPEVIPMFSALSEGATPQDLNMMLNIVGGHQAAMQMLKDTINEEAADWDRTHPVHAGPIPPGQMREPRGSDIAGTTSTLQEQIGWMTSNPPVPVGEIYKRWIILGLNKIVRTYSPISILDIRQGPKEPFRDYVDRFFKCLRAEQATQEVKNWMTETLLVQNANPDCKSILKALGTGATLEEMMTACQGVGGPSHKARVLAEAMSQASNAAAAIMMQKSKFKGQRRTIKCFNCGKEGHLARNCRAPRKKGCWKCGKEGHQMKDCTERQANFLGRMWPSSKGRPGNFLQNRPEPTAPPAECLERKEETTSSLKQEPRDKELYPLTSLKSLFGSDPLSQ

SEQ ID NO: 179 - protein, 494 aa, Human immunodeficiency virus type 1
  isolate=96ZM651.8; gene=gag
MGARASILRGGKLDKWEKIRLRPGGKKRYMIKHLVWASRELERFALNPGLLETSEGCKQIMKQLQPALQTGTEELRSLYNTVATLYCVHEGVEVRDTKEALDRIEEEQNKIQQKIQQKTQQAADGKVSQNYPIVQNLQGQMVHQKLSPRTLNAWVKVIEEKAFSPEVIPMFTALSEGATPQDLNTMLNTVGGHQAAMQMLKDTINEEAAEWDRLHPVHAGPIAPGQMREPRGSDIAGTTSTLQEQIAWMTSNPPIPVGDIYKRWIILGLNKIVRMYSPVSILDIKQGPKEPFRDYVDRFFKTLRAEQATQEVKNWMTDTLLVQNANPDCKTILKALGPGATLEEMMTACQGVGGPSHKARVLAEAMSQTNSVNILMQKSNFKGNKRMVKCFNCGKEGHIARNCRAPRKKGCWKCGKEGHQMKDCTERQANFLGKIWPSHKGRPGNFLQNRPEPTAPPAESFRFEETTPAPKQESKDREALTSLKSLFGSDPLSQ

SEQ ID NO: 180 - protein, 498 aa, Human immunodeficiency virus type 1
  Xaa=unknown 312: isolate=96ZM751.3; gene=gag
MGARASILRGGKLDEWERIRLRPGGKKHYMMKHLIWASRELERFALNPGLLETSEGCKQIIQQLQPALQTGTEELRSLYNTVATLYCVHEKIKVRDTKEALDKIEEEQNKSQQKIQKTEATGGKVSQNYPIVQNLQGQMVHQAISPRTLNAWVKVIEEKGFNPEVIPMFTALSEGATPQDLNTMLNTVGGHQAAMQMLKDTINEEAAEWDRLHPVHAGPIAPGQIREPRGSDIAGTTGTLQEQIAWMTNNPPIPVGDIYKRWIILGLNKIVRMYSPVSILDIKQGPKEPFRDYVDRFFKTLRAEQATQDVKXWMTDTLLVQNANPDCKTILRALGPGATLEEMMTACQGVGGPGHKARVLAEAMSQVNNTNIMMQKSNFKGPKRIVKCFNCGREGHIARNCRAPGKKGCWKCGKEGHQMKDCTERQANFLGKIWPSQKGRPGNFLQNRPEPTAPPAPTAPPAESFRFEETTPAPRQEQKDKEPLTALKSLFGSDPLSQ

SEQ ID NO: 181 - protein, 496 aa, Human immunodeficiency virus type 1
  isolate=94CY017.41; gene=gag
MGARASILSGGKLDAWEKIRLRPGGKKKYRLKHLVWASRELEKFSINPGLLETPEGCRQIIRQLQPALQTGTEELKSLYNTVVVLYWVHQRVDVKDTKEALDKIEEEQNKQKTQHAAADTGNSSSQNYPIVQNAQGQMVHQAISPRTLNAWVKVVEEKAFSPEVIPMFTALSEGATPQDLNTMLNTVGGHQAAMQMLKDTINEEAAEWDRVHPVHAGPIPPGQMREPRGSDIAGTTSTLQEQIGWMTSDPPIPVGEIYKRWIILGLNKIVRMYSPVSILDIRQGPKEPFRDYVDRFFKTLRAEQATQEVKNWMTDTLLVQNANPDCRSILRALGPGASLEEMMTACQGVGGPSHKARVLAEAMSHVQSTNTNIMMQRGNFRGQKRIKCFNCGKEGHLARNCRAPRKKGCWKCGKEGHQMKDCTERQANFLGKIWPSNKGRPGNFPQSRTEPTAPPAENLRMGEEITSSLKQELETREPYNPAISLKSLFGNDPLLQ

SEQ ID NO: 182 - protein, 491 aa, Human immunodeficiency virus type 1
  isolate=94IN476.104; gene=gag
MGARASILRGGKLDRWEKIRLRPGGKKHYMIKHLVWASRELERFALNPGLLETSDGCKQIIKQLHPALKTGTEELRSLFNTVATLYCVHAGIEVRDTKEALDKIEEEQNKSQQKIQQAKEADGKVSQNYPIVQNLQGQMVHQPLSPRTLNAWVKVIEEKAFSPEVIPMFTALSEGATPSDLNTMLNTVGGHQAAMQMLKDTINEEAAEWDRLHPVHAGPNPPGQMREPRGSDIAGTTSTLQEQIAWMTGNPPIPVGDIYKRWIILGLNKIVRMYSPVSILDIRQGPKEPFRDYVDRFFKTLRAEQATQEVKGWMTDTLLVQNANPDCKTILRALGPGASLEEMVTACQGVGGPSHKARVLAEAMSQSHSNIMMQRGNFKGPKRIVKCFNCGKEGHIARNCRAPRKRGCWKCGQEGHQMKDCTERQANFLGKIWPSHKGRPGNFLQNRPEPTAPPAESFRFKETTPAPKQESKDREPLTSLKSLFGSDPLSQ

SEQ ID NO: 183 - protein, 1003 aa, Human immunodeficiency virus type 1
  isolate=93BR020.1; gene=pol
FFRENLAFQQGEARKLHPEQARAVSPASRELQVRGGDNPISEAGAERRGTVPSLSFPQITLWQRPLVTIRVGGQLKEALLDTGADDTVLEDVNLPGKWKPKMIGGIGGFIKVKQYDSILIEICGHRAIGTVLVGPTPVNIIGRNMLTQIGCTLHFPISPIETVPVKLKPGMDGPKVKQWPLTEEKIKALTEICMEMEKEGKISKIGPENPYNTPVFAIKKKDSTKWRKLVDFRELNKRTQDFWEVQLGIPHPAGLKKKKSVTVLDVGDAYFSVPLDKDFRKYTASTIPSTNNETPGVRYQYNVLPQGWKGSPAIFQYSMTKILDPFRAKNPDIVIYQYMDDLYVGSDLEIGQHRTKIEELREHLLKWGLTTPDKKHQKEPPFLWMGYELHPDKWTVQPIQLPDKDSWTVNDIQKLVGKLNWASQIYPGIKVKQLCKLLRGAKALTDIVPLTTEAELELAENREILKEPVHGAYYDPSKDLIAEIQKQGQGQWTYQIYQEPFKNLKTGKYAKMRSAHTNDVKQLTEAVQKISLESIVIWGKTPKFRLPILKETWDTWWTEYWQATWIPEWEFVNTPPLVKLWYQLETEPIVGAETFYVDGASNRETKKGKAGYVTDRGRQKAVSLTETTNQKAELQAIQLALQDSGSEVNIVTDSQYALGIIQAQPDKSESELVNQIIEQLIKKEKVYLSWVPAHKGIGGNEQVDKLVSAGIRKVLFLDGIDKAQEEHEKYHNNWRAMASDFNIPAVVAKEIVASCDKCQLKGEAMHGQVDCSPGIWQLDCTHLEGKIILVAVHVASGYLEAEVIPAETGQETAYFLLKLAGRWPVKTIHTDNGTNFTSATVKAACWWAGIQQEFGIPYNPQSQGVVESMNKELKKIIGQIRDQAEHLKTAVQMAVFIHNFKRKGGIGGYSAGERTIDIIATDIQTRELQKQIIKIQNFRVYYRDSRDPVWKGPAKLLWKGEGAVVIQDNSEIKVVPRRKAKIIRDYGKQMAGDDCVAGRQDED

SEQ ID NO: 184 - protein, 1002 aa, Human immunodeficiency virus type 1
  isolate=92NG083.2; gene=pol
FFRENLAFQQGEARKLSPEQDRANSPTSRELRIRRGDSPLPEAGAKGEGAISLNFPQITLWQRPLVTVKIGGQLIEALLDTGADDTVLEGINLPGKWKPKMIGGIGGFIKVRQYDQILIEIGGKKAIGTVLVGPTPINIIGRNMLTQIGCTLNFPISPIETVPVKLKPGMDGPRVKQWPLTEEKIKALTEICKDMEKEGKISKIGPENPYNTPIFAIKKKDSTKWRKLVDFRELNKRTQDFWEVQLGIPHPAGLKKKRSVTVLDVGDAYFSVPLDKDFRKYTAFTIPSINNETPGIRYQYNVLPQGWKGSPAIFQSSMTKILEPSRTKNPEMVIYQYMDDLYVGSDLEIGQHRAKIEELREHLLKWGLTTPDKKHQKEPPFLWMGYELHPDKWTVQPIQLPEKEDWTVNDIQKLVGKLNWASQIYPGIKVKHLCRLLRGAKALTDIVPLTAEAEMELAENREILKEPVHGVYHDPSKELIAEVQKQGPDQWTYQIYQEPYKNLKTGKYAKRGSAHTNDVKQLTEVVQKIATEGIVIWGKIPKFKLPIRKETWEVWWTEYWQAAWIPEWEFVNTPPLVKLWYQLETEPIPGAETYYVDGAANRETKLGKAGHVTDKGKQKIITLTETTNQKAELHAIQLALQDSRPEVNIVTDSQYALGIIQAQPDRSGSELVNQIIEQLIKKEKVYLSWVPAHKGIGGNEQVDKLVSSGIRKVLFLDGIDKAQEEHERYHSNWRAMASDFNLPPVVAKEIVASCDKCQLKGEAMHGQVDCSPGIWQLDCTHLEGKIIIVAVHVASGYIEAEVIPAETGQETAYFILKLAGRWPVKVIHTDNGPNFISAAVKAACWWANITQEFGIPYNPQSQGVVESMNKELKKIIGQVGDQAEHLKTAVQMAVFIHNFKRKGGIGGYSAGERIIDIIASDIQTKELQKQIIKIQNFRVYYRDSRDPIWKGPAKLLWKGEGAVVIQDNNEIKVVPRRKAKILKDYGKQMAGGDCVAGRQDED

SEQ ID NO: 185 - protein, 1002 aa, Human immunodeficiency virus type 1
  isolate=90CF056.1; gene=pol
FFRENLAFQQREARKFSPEQARTNSPTSRELRVRRGDDPLSEAGAAEGQGTSLSFPQITLWQRPLVTVKIEGQLREALLDTGADDTVLEEINLPGKWKPKMIGGIGGFIKVRQYEQVAIEICGKKAIGTVLVGPTPVNIIGRNILTQIGCTLNFPISPIETVPVKLKPGMDGPKVKQWPLTEEKIKALTEICTEMEKEGKISRIGPENPYSTPIFAIKKKDSTKWRKLVDFRELNKRTQDFWEVQLGIPHPAGLKKKKSVSVLDVGDAYFSVPLDKEFRKYTAFTIPSINNETPGIRYQYNVLPQGWKGSPAIFQSSMTKILAPFREQNPEMVIYQYMDDLYVGSDLEIGQHRAKIEELRAHLLKWGFTTPDKKHQKEPPFLWMGYELHPDKWTVQTVKLPEKDSWTVNDIQKLVGKLNWASQIYPNIKVKQLCKLLRGAKALTDIIPLTKEAELELAENREILREPIHGVYYDPSKDLIAEIRKQGQGQWTYQIYQEPFKNLKTGKYAKMRTAHTNDIKQLTEAVQKISTESIVIWGKIPKFRLPIQKETWETWWTEYWQATWIPEWEFVNTPHLVKLWYQLETEPIAGAETYYIDGAANRETKLGKAGYVTDRGKQKVVSLTETTNQKTELQAIYLALQDSGLEVNIVTDSQYALGIIQAQPDKSESELVNQIIEELIKKEKVYLSWVPAHKGIGGNEQVDKLVSSGVRKVLFLDGIDKAQEEHERYHNNWRAVASDFNLPPIVAKEIVASCDKCQLKGEAMHGQVDCSPGIWQLDCTHLEGQVILVAVHVASGYIEAEVIPAETGKETAYFLLKLASRWPVKVIHTDNGSNFTSAAVKAACWWADIQQEFGIPYNPQSQGVVESMNKELKKIIGQVRDQAEHLKTAVQMAVFIHNFKRKGGIGGYSAGERIIDIIATDIQTKELQKQISNIQKFRVYYRDSRDPIWKGPAKLLWKGEGAVVIQDNSEIKVVPRREAKIIRDYGKQMAGDDCVASRQDED

SEQ ID NO: 186 - protein, 1000 aa, Human immunodeficiency virus type 1
  isolate=92RW009.6; gene=pol
FFRENLAFQQGEARKFSPEQTGANSPTSRELWNGGRDSLSSETGAERQGTFNFPQITLWQRPLVTVKIGGQLREALLDTGADDTVLEEINLPGKWKPKMIGGIGGFIKVKQYDQILIEICGKKAIGTVLVGPTSVNIIGRNMLTQIGCTLNFPISPIETVPVALKPGMDGPKVKQWPLTEEKIKALREICTEMEKEGKISKIGPENPYNTPVFAIKKKDSTKWRKLVDFRELNKRTQDFWEVQLGIPHPAGLKKKKSVTVLDVGDAYFSVPLDESFRKYTAFTIPSINNETPGIRYQYNVLPQGWKGSPAIFQNSMTKILEPFRAQNQEIVIYQYMDDLYVGSDLEIGQHRAKIEELREHLLKWGFTTPDKKHQKEPPFLWMGYELHPDKWTVQPIQLPEKDSWTVNDIQKLVGKLNWASQIYPGVKVRQLCKLLRGTKALTDIVPLTEEAELELAENREILKEPVHGVYYDPSKDLIAEIQKQGHDQWTYQIYQEPFKNLKTGKYAKRRTAHTNDVKQLTEAVQKIAMESIVIWGKTPKFRLPIQKETWETWWTDYWQATWIPEWEFVNTPPLVKLWYQLEKEPILGAETFYVDGAANRETKIGKAGYVTDRGRQKIVSLTETTNQKTELQAIQLALQDSGSEVNIVTDSQYALGIIQAQPDSSESEAVNQIIEQLIKKERVYLSWVPAHKGIGGNEQVDKLVSSGIRRVLFLDGIDKAQEEHERYHSNWRAMASDFNLPPIVAKEIVASCDKCQLKGEAMHGQVDCSPGIWQLDCTHLEGKIILVAVHAASGYIEAEVIPAETGQETAYFILKLAGRWPVKVIHTDNGSNFTSNTVKAACWWAGIQQEFGIPYNPQSQGVIESMNKELKKIIGQVRDQAEHLRTAVQMAVFIHNFKRKGGIGGYSAGERIIDIIATDIQTKELQKQITKIQNFRVYYRDSRDPIWKGPAKLLWKGEGAVVIQDNSDIKVVPRRKAKIIRDYGKQMAGDDCVAGRQDED

SEQ ID NO: 187 - protein, 1002 aa, Human immunodeficiency virus type 1
  isolate=92NG003.1; gene=pol
FFRENLAFQQGEAREFSSEQARANSPTRRELRVRRGDSPFPEAGAEGKGITSINLPQITLWQRPLVTVRIGGQLIEALLDTGADDTVLEQINLPGKWKPKMIGGIGGFIKVKQYDQILIEIEGKKAIGTVLVGPTPINIIGRNMLTQIGCTLNFPISPIETVPVKLKPGIDGPKVKQWPLTEEKIKALTEICTDMEKEGKISKIGPENPYNTPIFAIKKKDSTKWRKLVDFRELNKRTQDFWEVQLGIPHPAGLKKKRSVTVLDVGDAYFSIPLDENFRKYTAFTIPSINNETPGIRYQYNVLPQGWKGSPAIFQSSMTKILEPFRTENPEIVIYQYMDDLYVGSDLETGQHRAKIEELRNHLLRWGFTTPDKKHQKEPPFLWMGYELHPDKWTVQPIQLPNKESWTVNDIQKLVGKLNWASQIYPGIKVKQLCKLLRGAKALTDIVPLTEEAELELAENREILKEPVHGVYYDPSKELIAELQKQGCDQWTYQIYQEPYKNLKTGKYAKRGSAHTNDVKQLTEAVQKIATESIVIWGKVPKFKLPIRKETWEVWWTEYWQATWIPDWEFVNTPPLVKLWYRLETEPIPGAETYYVDGAANKETKLGKAGYVTDRGKQKIITIQETTNQKTELHAIQLALQDSGSEVNIVTDSQYALGIIQAQPDRSESELVNQIIEQLIKKEKVYLTWVPAHKGIGGNEQVDKLVSSGIRKVLFLDGIDKAQEDHERYHSNWRAMASDFNLPPIVAKEIVASCDKCQLKGEAMHGQVDCSPGIWQLDCTHLEGKVIIVAVHVASGYIEAEVIPAETGQETAYFLLKLAGRWPVKVIHTDNGSNFTSAAMKAACWWANIQQEFGIPYNPQSQGVVESMNKELKKIIGQVRDQAEHLKTAVQMAVFIHNFKRKGGIGGYSAGERIIDIIASDIQTKELQKQIIKIQNFRVYYRDSRDPIWKGPAKLLWKGEGAVVIQDNSEIKVVPRRKVKIIKDYGKQMAGGDCVAGRQDED

SEQ ID NO: 188 - protein, 1003 aa, Human immunodeficiency virus type 1
  isolate=93BR029.4; gene=pol
FFRENLAFPQGKAREFPSEQTRANSPTSRELQVWGRGNNSLSETGADRQGDVSFGFPQITLWQRPLVTVKIGGQLKEALLDTGADDTVLEEINLPGRWKPKMIGGIGGFIKVRQYDQIPIEICGRKATGTVLVGPTPVNIIGRNLLTQIGCTLNFPISPIETVPVKLKPGMDGPRVKQWPLTEEKIKALTEICTEMEKEGKISKIGPENPYNTPVFAIKKKDSTKWRKLVDFRELNKRTQDFWEVQLGIPHPAGLKKKKSVTVLDVGDAYFSVPLDKDFRKYTAFTIPSTNNETPGLRYQYNVLPQGWKGSPAIFQSSMTKILEPFRKQNPDIVIYQYMDDLYVGSDLEIGQHRTKIEELRQHLLRWGFTTPDKKHQKEPPFLWMGYELHPDKWTVQPIVLPEKDSWTVNDIQKLVGKLNWASQIYAGIKVRQLCKLLRGTKALTEVVPLTAEAELELAENREILKEPVHGVYYDPSKDLIAEIQKQGQGQWTYQIYQEPYKNLKTGKYARMRGAHTNDVKQLTEAVQKITTESIVIWGKIPKFKLPIQKETWEAWWIEYWQATWIPEWEFVNTPPLVKLWYQLEKEPIVGAETFYVDGAANRETKLGKAGYVTDRGRQKVVPLTDTTNQKTELQAIHLALQDSGLEVNIVTDSQYALGIIQAQPDKSELEIVNQIIEQLIKKEKIYLAWVPAHKGIGGNEQVDKLVSSGIRKVLFLDGIDKAQEEHEKYHNNWRAMASDFNIPPVVAKEIVASCDKCQLKGEAMHGQVDCSPGIWQLDCTHLEGKVILVAVHVAGGYIEAEVIPAETGQETAYFLLKLAGRWPVKTIHTDNGSNFTSTTVKAACWWAGIKQEFGIPYNPQSQGVIESMNKELKKIIGQVRDQAEHLKTAVQTAVFIHNFKRKGGIGGYSAGERIVDIIATDIQTKELQKQITKIQNFRVYYRDSRDPLWKGPAKLLWKGEGAVVIQDNSDIKVVPRRKVKIIRDYGKQMAGGDCVAGRQDED

SEQ ID NO: 189 - protein, 1002 aa, Human immunodeficiency virus type 1
  isolate=94CY032.3; gene=pol
FFRENVAFQQREARKFSSEQARANSPARGMLREERGDNLLSEAGTEGQGTISFNFPQITLWQRPLVTIKLGGQIREALLDTGADDTVLEEINLPGKWKPKMIGGIGGFIKVRQYDQIPIEICGKKAIGTVLVGPTPVNIIGRNMLTQLGCTLNFPISPIETVPVKLKPGMDGPKVKQWPLTEEKIKALTEICTDMEKEGKISKIGPENPYNTPIFAIKKKDSTKWRKLVDFRELNKRTQDFWEVQLGIPHPAGLKKKKSVTVLDVGDAYFSVPLDPEFRKYTAFTIPSTNNETPGIRYQYNVLPQGWKGSPAIFQCSMTKILEPFRFKNPEIVIYQYMDDLYVGSDLEIGQHRAKIEELREHLLRWGFTTPDKKHQKEPPFLWMGYELHPDKWTVQPIQPAEKDSWTVNDIQKLVGKLNWASQIYPGIKVKQLCKLLRGAKALTDIVPLTTEAELELAENREILKEPVHGAYYDPSKDLIAEIQKQGQGQWTYQIYQEPHKNLKTGKYARTRSAHTNDVRQLTEAVQKIAMECIVIWGKTPKFRLPIQKETWDTWWTEYWQATWIPEWEFVNTPPLVKLWYQLETDPIAGAETFYVDGAANRETKQGKAGYVTDRGRQKVVSLSETTNQKTELQAIYLALQDSGSEVNIVTDSQYAIGIIQAQPDRSESDLVNQIIEQLIRKDKVYLSWVPAHKGIGGNEQVDKLVSNGIRKVLFLDGIDKAQEEHEKYHNNWRAMASDFNLPSVVAKEIVASCNKCQLKGEAMHGQVDCSPGIWQLDCTHLEGKVIMVAVHVASGYIEAEVIPAETGQETAYFILKLAGRWPVKMIHADNGPNFTSAAVKAACWWADINQEFGIPYNPQSQGVVESMNKELKKIIGQVRDQAEHLKTAVQMAVFIHNFKRKGGIGGYSAGERIIDIIASDIQTKELQKQITKIQNFRVYYRDSREPIWKGPAKLLWKGEGAVVIQDNSDIKVVPRRKAKIIRDYGKQMAGNDCVAGRQDED

SEQ ID NO: 190 - protein, 999 aa, Human immunodeficiency virus type 1
  isolate=96ZM651.8; gene=pol
FFRENLAFPQGKAREFPSEQARANSPTSRELQVRGDNPRSEAGVERQGSLNFPQITLWQRPLVSIKVGGQIKEALLDTGAGDTVLEEINLPGKWKPKMIGGIGGFIEVRQYDQIPMEICGKKAIGTVLVGPTPVNIIGRNMLTQLGCTLNFPISPIETVPVKLKPGMDGPKVKQWPLTEEKIKALTAICEEMEKEGKITKIGPENPYNTPVFAIKKKDSTKWRKLVDFRELNKRTQDFWEVQLGIPHPAGLKKKKSVTVLDVGDAYFSVPLDESFRKYTAFTIPSTNNETPGIRYQYNVLPQGWKGSPAIFQSSMTKILEPFRAQNPDIVIYQYMDDLYVGSDLEIGQHRAKIEELREHLLKWGFTTPDKKHQKEPPFLWMGYELHPDKWTVQPIQLAEKDSWTVNDIQKLVGKLNWASQIYAGIKVRQLCKLLRGAKALTDIVPLTEEAELELAENKEILKEPVHGVYYDPSKDLIAEIQKQGHDQWTYQIYQEPFKNLKTGKYAKMRTAHTNDVKQLTEAVQKIALESIVIWGKIPKFRLPIQKETWETWWTDYWQATWIPEWEFVNTPLLVKLWYQLEKEPIVGAETFYVDGAANRETKLGKAGYITDRGRQKIVTLTETTNQKTELQAIYLALQDSGSEVNIVTDSQYALGIIQAHPDKSESELVNQIIEQLIKKERVYLSWVPAHKGIGGNEQVDKLVSKGIRKVLFLDGIDKAQEEHEKYHNNWRAMASEFNLPPVVAKEIVASCDKCQQKGEATHGQVDCSPGIWQLDCTHLEGKIILVAVHVASGYIEAEVIPAETGQETAYYILKLAGRWPVKVIHTDNGSNFTSAAVKAACWWAGIKQEFGIPYNPQSQGVVESMNKELKKIIGQVRDQAEHLKTAVQMAVFIHNFKRKRGIGGYSAGERIIDIIATDIQTKELQKQIINIQKFRVYYRDSRDPIWKGPAKLLWKGEGAVVIQDNSDIKVVPRRKAKIIRDYGKQMAGADCVAGRQDED

SEQ ID NO: 191 - protein, 1005 aa, Human immunodeficiency virus type 1
  Xaa=unknown 424: isolate=96ZM751.3; gene=pol
FFRENLAFPEGEAGELPSEQTRANSPTSSNSPTSRELQVRGDNPCPEAGAERQGTLNCPQITLWQRPLVSIKVGGQIKEALLDTGADDTVLEEINLPGKWKPKMIGGIGGFIKVRQYDQILIEICGKKAIGTVLVGPTPVNIIGRNMLTQLGCTLNFPISPIETVPVKLKPGMDGPRVKQWPLTEEKIKALTAICEEMEKEGKITKIGPENPYNTPVFAIKKKDSTKWRKLVDFRELNKRTQDFWEVQLGIPHPAGLKKKKSVTVLDVGDAYFSVPLDEGFRKYTAFTIPSINNETPGIRYQYNVLPQGWKGSPSIFQSSMIKILEPFRTQNPEIVIYQYMDDLYVGSDLEIGQHRAKIEELREHLLRWGFTTPDKKHQKEPPFLWMGYELHPDKWTVQPIKLPEKESWTVNDIQKLVGKLNWXSQIYAGIKVRQLCKLLRGAKALTDIVPLTEEAELELAESREILKEPVHGVYYDPSKDLIAEIQKQGHDQWTYQVYQEPFKNLKTGKYAKMRTAHTNDVKQLTEAVQKIAMESIVIWGKIPKFRLPIQKETWETWWTDYWQATWIPEWEFVNTPPLVKLWYQLEKEPIAGAETYYVDGAANRETKIGKAGYVTDRGRQKIVTLTETTNQKTELQAIQLALQDSGSEVNIVTDSQYALGIIQAQPDKSESELVNQIIEQLIKKERVYLSWVPAHKGIGGNEQVDKLVSSGIRKVLFLDGIDKAQEEHEKYHSNWRAMASEFNLPPIVAKEIVASCDKCQLKGEAIHGQVDCSPGIWQLDCTHLEGKVILVAVHVASGYIEAEVTPAETGQETALFILKLAGRWPVKVVHTDNGSNFTSAAVKAACWWAGIHQEFGIPYNPQSQGVVESMNKELKKIIGQVRDQAEHLKTAVQMAVFIHNFKRKGGIGGYSAGERIIDIIATDIQTRELQKQIIKIQNFRVYYRDSRDPIWKGPAKLLWKGEGAVVIQDNSDIKVIPRRKAKIIRDYGKQMAGTDSVAGRQDED

SEQ ID NO: 192 - protein, 1003 aa, Human immunodeficiency virus type 1
  isolate=94CY017.41; gene=pol
FFRENLAFQQREARKFSSEQNRANSPTSRELENGGRDNLLPEAGTGDQGTIQSCNFPQITLWQRPLVTVKIEGQLKEALLDTGADDTVLEEINLPGKWRPKMIGGIGGFIKVKQYDQIAIEICGKRAIGTVLVGPTPVNIIGRNMLVQLGCTLNFPISPIETVPVKLKPGMDGPKVKQWPLTEEKIKALTEICKEMEKEGKISKIGPENPYNTPVFAIKKKDSTKWRKLVDFRELNKRTQDFWEVQLGIPHPAGLKKKKAVTVLDVGDAYFSVPLHEDFRKYTAFTIPSTNNETPGVRYQYNVLPQGWKGSPAIFQSSMTKILEPFRSKNTELIIYQYMDDLYVGSDLEISQHRVKIEELRAHLLKWGFYTPDKKHQKEPPFLWMGYELHPDKWTVQPIKLPEKDSWTVNDIQKLVGKLNWASQIYAGIKVKQLCKLLRGAKALTDIVTLTKEAELELEENREILKTPVHGVYYDPSKDLIAEIQKQGQDQWTYQIYQEPFKNLKTGKYAKRRSTHTNDIKQLTEAVQKITMESIVIWGKTPKFKLPIQKETWETWWAEYWQATWIPEWEFVNTPPLVKLWYQLEKEPIAGAETFYVDGAANRETKLGKAGYVTDRGRQKIVSLTETTNQKTELHAIYLALQDSGLEVNIVTDSQYALGIIQAQPERSESEIVNQIIEKLIEKERVYLSWVPAHKGIGGNEQVDKLVSSGIRKVLFLDGIDKAQEEHERYHSNWRAMAHDFNLPPVVAKEIVASCDKCQLKGEAMHGQVDCSPGIWQLDCTHLEGKVILVAVHVASGYIEAEVIPTETGQDTAYFILKLAGRWPVKVIHTDNGPNFISATVKAACWWAGIQQEFGIPYNPQSQGVVESMNKELKKIIGQVRDQAEHLKTAVQMAVFIHNFKRKGGIGGYSAGERIIDIIATDIQTKELQRQITKIQNFRVYYRDSRDPIWKGPAKLLWKGEGAVVIQDNSDIKVVPRRKAKIIRDYGKQMAGDDCVAGRQDED

SEQ ID NO: 193 - protein, 1003 aa, Human immunodeficiency virus type 1
  Xaa=unknown 535: isolate=94IN476.104; gene=pol
FFRENLAFPQGEAREFPSKQARANSPTSRELQVQGDNPRSEAGVERQGTLNFPQITLWQRPLVSIKVGGQIKEALLDTGADDTVLEEIALPGRWKPKMIGGIGGFIKVRQYDQILIEICGKKAIGTVLVGPTPVNIIGRDMLTQLGCTLNFPISPIETVPVKLKPGMDGPKVKQWPLTEEKIKALTEICMEKEKEGKITKIGPENPYNTPVFAIKRKDSTKWRKLVDFRELNKRTQDFWEVQLGIPHPAGLKKKKSVTVLDVGDAYFSVPLDEGFGKYTAFTIPSINNETPGIRYQYNVLPQGWKGSPAIFQSSMTKILEPFRARNPKIVIYQYMDDLYVGSDLEIGHHRAKIEELRAHLLKWGFTTPDKKHQKEPPFLWMGYELHPDKWTVQPIKLPEKDSWTVNDIQKLVGKLNWASQIYPGIKVRQLCKLLRGAKALTDIVPLTEEAELELAENREILKEPVHGVYYDPSKDLIAEIQKQGHDQWTYQIYQEPFKNLKTGKYAKMRTAHTNDVKQLTEAVQKIAIESIVIWXKTPKFRLPIQKETWETWWTDYWQATWIPDWEFVNTPPLVKLWYQLEKEPIVGAETFYVDGAANRETKVGKAGYVTDRGRQKIVSLTETTNQKTELQAIQLALQDSGTEVNIVTDSQYALGIIQAQPDKSESELVNQIIEQLINKERVYLSWVPAHKGIGGNEQVDRLVSSGIRKVLFLDGIDKAQEDHEKYHSNWRAMANEFNLPPIVAKEIVASCDKCQLKGEAMHGQVDRSPGIWQLDCTHLEGKIILVAVHVASGYIEAEVIPAETGQETAYYILKLAGRWPVKVIHTDNGSNFTSAAVKAACWWAGIQQEFGIPYNPQSQGVVESMNKELKKIIGQVREQAEHLKTAVQMAVFIHNFKRKGGIGGYSAGERTIDIIATDIQTKELQNQITKIQNFRVYYRDSRDPIWKGPAKLLWKGEGAVVIQDNSDIKVVPRRKAKIIRDYGKQMAGADCVAGRQDEDQNME

SEQ ID NO: 194 - protein, 192 aa, Human immunodeficiency virus type 1
  isolate=93BR020.1; gene=vif
MENRWQVMIVWQVDRMRINTWKSLVKYHMHISKKAKGWFYRHHFESRHPKISSEVHIPLETAELVITTYWGLLPGEREWHLGQGVSIEWRQGRYRTQIDPGLADQLIHIYYFDCFSESAIRKAILGHKISPRCNYQAGHNKVGSLQYLALTALIAPKKTKPPLPSVQKLVEDRWNKPQKTRGHRESHTMNGH

SEQ ID NO: 195 - protein, 192 aa, Human immunodeficiency virus type 1
  isolate=92NG083.2; gene=vif
MENRWQVVIVWQVDRMRIRTWNSLVKHHMYVSKKAKGWFYRHHYESRHPRVSSEVHIPLRDATLVVRTYWGLHAGEKDWQLGHGVSIEWRQKRYSTQIDPNTADHLIHLYYFDCFSESAIRKAILGEIVSPRCEYPAGHNKVGSLQYLASKALVTPTRKRPPLPSVGKLAEDRWNKPQKTRDHRENPTMNGH

SEQ ID NO: 196 - protein, 192 aa, Human immunodeficiency virus type 1
  isolate=90CF056.1; gene=vif
MENRWQVMIVWQVDRMRINTWKSLVKYHMHISRKARGWFYRHHFESTHPRISSEVHIPLGEARLVITTYWGLNTGEREWHLGQGVSIEWRLKRYSTQVEPGLADQLIHMHYFDCFSESAIRKAILGRVVRPRCNYPAGHKQVGTLQYLALTALVAPKKIKPPLPSVRKLVEDRWNKPQKTRGHRGSHTMNGH

SEQ ID NO: 197 - protein, 192 aa, Human immunodeficiency virus type 1
  isolate=92RW009.6; gene=vif
MENRWQVMIVWQVDRMKIRTWNSLVKHHMYASRRAKGWFYRHHYESRHPKISSEVHIPLGEARLVIKTYWGLQTGERDWHLGHGVSIEWRLRRYKTQVDPGLAGQLIHMHYFDCFADSAIRKAILGHIVSPRCDYQAGHNKVGSLQYLALTALIKPKKIKPPLPSVSKLVEDKWNKPQKTRGRRGNHTMNGH

SEQ ID NO: 198 - protein, 192 aa, Human immunodeficiency virus type 1
  isolate=92NG003.1; gene=vif
MENRWQVVIVWQVDRMRIRTWNSLVKYHMYKSKKAKDWFYRHHYESRHPKVSSEVHIPLGEARLVVRTYWGLHTGERDWHLGQGVSIEWKQRRYSTQIDPDLADQLIHLHYFNCFSESAVRKAILGEVVRPRCEYQTGHNQVGSLQYLALKALVTPTQTKPPLPSVKKLTEDRWNEPQKTRGHRGSHSTNGH

SEQ ID NO: 199 - protein, 192 aa, Human immunodeficiency virus type 1
  isolate=93BR029.4; gene=vif
MENRWQVVIVWQVDRMRINTWKSLVKYHMHVSKKAKRWFYRHHFESRHPRVSSEVHIPLEEAKLVITTYWGLHTGERDWHLGQGVSIEWRQGRYRTQIDPGLADQLIHIYYFDCFSESAIRKAILGHRISPRCDYQAGHNKVGSLQYLALTALIKPKKRKPPLPSVKKLTEDRWNKPQKTKDHRGSHTMNGH

SEQ ID NO: 200 - protein, 191 aa, Human immunodeficiency virus type 1
  isolate=94CY032.3; gene=vif
MANRWQVMIVWQVDRMKIRTWNSLVKHHMYVSKKAKGFYRHHYESRHPKVSSEVHIPLGEARLVVRTYWGLQPGEQDWHLGHGVSIEWRLRRYSTQVDPDLADQLIHMHYFDCFSESAIRKAILGHRVSPRCEYQAGHNKVGSLQYLALAALISPKKTKPPLPSVKKLVEDRWNKPQKTRGRRENQIMNGH

SEQ ID NO: 201 - protein, 192 aa, Human immunodeficiency virus type 1
  isolate=96ZM651.8; gene=vif
MENRWQALIVWQVDRMRIRTWNSLVKHHMYISRKANGWFYRHHYESRHPRVSSEVHIPLGDAKLVIKTYWGLQTGERDWHLGHGVSIEWRLRRYSTQVDPGLADQLIHMHYFDCFADSAIRKAILGHIVIPRCDYQAGHNKVGSLQYLALTALIKPKKRKPPLPSVRKLVEDRWNNSQKTKGRRGNHTVSGH

SEQ ID NO: 202 - protein, 192 aa, Human immunodeficiency virus type 1
  isolate=96ZM751.3; gene=vif
MENRWQVLIVWQVDRMKIRTWNSLVKHHMYVSKRTGRWFYRHHYESRHPKISSEVHIPLGDAKLVIKTYWGLHPGEREWHLGHGVSIEWRLRRYSTQVDPGLADQLIHMHYFNCFADSAIRKALLGHIVIPRCDYQAGHNKVGSLQYLALTALIKPKKIKPPLPSVRKLVEDRWNKPQKTKGRRGNHIMNGH

SEQ ID NO: 203 - protein, 192 aa, Human immunodeficiency virus type 1
  isolate=94CY017.41; gene=vif
MENRWQVMIVWQVDRMRIRTWNSLVKHHMYISRKAKGWVYKHHYESRNPRISSEVHIPLGEARIIVRTYWGLHIGEKDWHLGHGVSIEWRQNRYHTQIDPDLADHLIHLYYFDCFSESAIRKAIIGEIVSPRCEYQAGHNKVGSLQYLALKAVVASTRTKPPLPSVRKLVEDRWNKPQKTKGHRGSHTMNGC

SEQ ID NO: 204 - protein, 192 aa, Human immunodeficiency virus type 1
  isolate=94IN476.104; gene=vif
MENRWQVLIVWQVDRMRIRTWNSLVKHHMYVSRRASGWFYRHHYESRHPKVSAEVHIPLGDARLVIKTYWGLQTGERDWHLGHGVSIEWRLGRYSTQVEPGLADQLIHMHYFDCFADSAIRKAILGHIVISRCDYQAGHNKVGSLQYLALTALIKPKKRKPPLPSVKKLVEDRWNNPQKTRDHRGNHTMNGH

SEQ ID NO: 205 - protein, 96 aa, Human immunodeficiency virus type 1
  isolate=93BR020.1; gene=vpr
MEQAPEDQGPQREPYNEWTLDLLEELKNEAVRHFPRPWLHSLGQHIYNTYGDTWEGVEAIIRILQQLLFIHFRIGCRHSRIGITRQRRVRNGTSRS

SEQ ID NO: 206 - protein, 96 aa, Human immunodeficiency virus type 1
  isolate=92NG083.2; gene=vpr
MEQAPEDQGPQREPYNEWTLELLEELKNEAVRHFPRPWLHGLGQYIYNTYGDTWEGVEAIIRILQQLLFIHFRIGCQHSRIGITPQRRVRDGPGRP

SEQ ID NO: 207 - protein, 96 aa, Human immunodeficiency virus type 1
  isolate=90CF056.1; gene=vpr
MEQAPEDQGPQREPHNEWTLELLEEIKNEAVRHFPRVWLHQLGQHIYNTYGDTWVGVEALIRTLQQLLFIHFRIGCQHSRIGITRQRRVRNGPSRS

SEQ ID NO: 208 - protein, 96 aa, Human immunodeficiency virus type 1
  isolate=92RW009.6; gene=vpr
MEQAPEDQGPQREPYNEWTLELLEALKQEAVRHFPRPWLHDLGQYIYETYGDTWRGVEAIIRILQQLLFIHFRIGCRHSRIGILQQRRARNGASRS

SEQ ID NO: 209 - protein, 92 aa, Human immunodeficiency virus type 1
  Xaa=unknown 33: isolate=92NG003.1; gene=vpr
MERAPEDQGPQREPFNEWTLELLEELKHEAVRXWLHGLGQHIYNTYGDTWEGVVAIIRILQQLLFIHFRIGCQHSRIGIIPGRRGRNGAGRS

SEQ ID NO: 210 - protein, 96 aa, Human immunodeficiency virus type 1
  isolate=93BR029.4; gene=vpr
MEQAPEDQGPQREPYNEWTLELLEELKSEAVRHFPRLWLHSLGQHIYETYGDTWAGVEAIIRILQQLLFIHFRIGCQHSRIGINRQRRARNGASRS

SEQ ID NO: 211 - protein, 95 aa, Human immunodeficiency virus type 1
  isolate=94CY032.3; gene=vpr
MEQAPEDQGPQREPNNEWTLELLEELKNEAVRHFPRPWLHGLGQHIYNTYGDTWEGVEAIIRILQQLLFIHFRIGCQHSRIGITPQRRRGRGWSQ

SEQ ID NO: 212 - protein, 96 aa, Human immunodeficiency virus type 1
  isolate=96ZM651.8; gene=vpr
MEQFPEDQGPQREPYSEWTLEILEELKQEAVRHFPRPWLHSLGQHIYETYGDTWTGVEAIIRILQQLLFIHFRIGCQHSRIGMVRQRRARNGASRS

SEQ ID NO: 213 - protein, 96 aa, Human immunodeficiency virus type 1
  isolate=96ZM751.3; gene=vpr
MEQAPENQGPQREPYNEWALELLEELKQEAVRHFPRTWLHNLGQHIYQTYGDTWTGVEALIRILQQLLFIHFRIGCQHSRIGIMRQRRARNGASRS

SEQ ID NO: 214 - protein, 96 aa, Human immunodeficiency virus type 1
  isolate=94CY017.41; gene=vpr
MEQAPEDQGPQREPYNEWMLELLEELKQEAVRHFPRHWLHGLGQYIYNTYGDTWEGVEVIIRYLQQLLFVHFRIGCQHSRIGIIRRRRVRDGASRP

SEQ ID NO: 215 - protein, 95 aa, Human immunodeficiency virus type 1
  isolate=94IN476.104; gene=vpr
MEQSPEDQGPQREPYNEWTLELLEELKQEAVRHFPRPLHSLGQYIYETYGDAWTGVEALIRTLQQLLFIHFRIGCQHSRIGILQRRRARNGASRS

SEQ ID NO: 216 - protein, 99 aa, Human immunodeficiency virus type 1
  isolate=93BR020.1; gene=tat
MELVDPNLDPWNHPGSQPTTPCTRCYCKWCCFHCYWCFTTKGLGISYGRKKRRQRPRTPQSSQIHQDFVPKQPISQARGNPTGPKESKKEVESKAKTDP

SEQ ID NO: 217 - protein, 101 aa, Human immunodeficiency virus type 1
  isolate=92NG083.2; gene=tat
MDPVDPKLEPWNHPGSQPTTPCNKCYCKVCCWHCQVCFLNKGLGISYGRKKRRPRRGTPQGSKDHQNPVPKQPLPITSGNPTGSEKPKKEVASKTETDPLD

SEQ ID NO: 218 - protein, 99 aa, Human immunodeficiency virus type 1
  isolate=90CF056.1; gene=tat
MDPVDPKLEPWNHPGSQPQTACNNCYCKKCCYHCQMCFLKKGLGISYGRKKRSQRHRTPASLQDHQNSISKQPLSRTHGDPTGPKEQKKEVASKTETDP

SEQ ID NO: 219 - protein, 101 aa, Human immunodeficiency virus type 1
  isolate=92RW009.6; gene=tat
MEPVDPKLEPWNHPGSQPKTACNNCYCKHCSYHCLVCFQAKGLGISYGRKKRRQRRNAPPSSEDHQNPISKQPLSQTRGDPTGSEESKKKVESKTEADPFD

SEQ ID NO: 220 - protein, 101 aa, Human immunodeficiency virus type 1
  isolate=92NG003.1; gene=tat
MELVDPSLEPWNHPGSQPTTACNKCYCKICCWHCQLCFLNKGLGISYGRKKRRRRRGTPQSHQDHQNPVPKQPLPTTRGNPTGPKESKKEVESKTETDQCA

SEQ ID NO: 221 - protein, 99 aa, Human immunodeficiency virus type 1
  isolate=93BR029.4; gene=tat
MEPVDPRLEPWKHPGSRPQTACNSCYCKKCCFHCQVCFTTKGLGISYGRKKRRQRHRTPQSSQLHQDPVPKQPASQAQGNPTGPKESKKEVESQAKTDP

SEQ ID NO: 222 - protein, 102 aa, Human immunodeficiency virus type 1
  isolate=94CY032.3; gene=tat
MEPVDPDLEPWNHPGSQPTTDCNKCFCKKCCWHCQVCFLKKGLGISYGRKKRKHRRGSLQGSKGHQNLIPKQPLSQQPNGDSTGPEEQKKKVASKTEADPFA

SEQ ID NO: 223 - protein, 101 aa, Human immunodeficiency virus type 1
  isolate=96ZM651.8; gene=tat
MEPVDPSIEPWNHPGSQPKTACNKCYCKRCSYHCLVCFQTKGLGISYGRKKRRQRRSTPPSSEDHQDPISKQPLSRTQGNPTGQEESKKKVESKTKRDPCD

SEQ ID NO: 224 - protein, 101 aa, Human immunodeficiency virus type 1
  isolate=96ZM751.3; gene=tat
MEPVDPRLEPWNHPGSQPKTPCNKCYCKHCSYHCLVCFQTKGLGISYGRKKRRQRRSAPPSSEDHQNPISKQPLSQPRGNQTGSEESKKKVESKTETDQFD

SEQ ID NO: 225 - protein, 101 aa, Human immunodeficiency virus type 1
  isolate=94CY017.41; gene=tat
MEPVDPKLEPWNHPGSQPKTACTKCYCKRCCYHCQLCFINKGLGISYGRKKRRPRRKPSPSNKDHQNPIPKQSLPQAQRVPTGPEEPKKEVESKAETDRFD

SEQ ID NO: 226 - protein, 101 aa, Human immunodeficiency virus type 1
  isolate=94IN476.104; gene=tat
MEPVDPNLEPWNHPGSQPKTACNTCYCKHCSYHCLVCFQTKGLGISYGRKKRRQRRSAPPSSEDHQNLISKQPLPQARGNPTGSEESKKKVESKTKTDPFD

SEQ ID NO: 227 - protein, 116 aa, Human immunodeficiency virus type 1
  isolate=93BR020.1; gene=rev
MAGRSGDSDQELLKAVRYIKILYQSNPYPKPEGTRQARRNRRRRWRARQRQIREISDRILSSCLGRPAEPVPLQLPPLERLHINCSEDCGQGAEEGVGSSQISGESHTVLGSGTKE

SEQ ID NO: 228 - protein, 123 aa, Human immunodeficiency virus type 1
  isolate=92NG083.2; gene=rev
MAGRSGDPDEELLRAVRIIKTLYQSNPYPSPAGTRQARKNRRRRWRARQRQIHSISERILSACLGRPAEPVPFQLPPLEGLSLDCSKDGGTSGTQQPQGTETGVGRPQVLVEPPVVLGSGTKE

SEQ ID NO: 229 - protein, 116 aa, Human immunodeficiency virus type 1
  isolate=90CF056.1; gene=rev
MAGRSGASDTELLQVCKIIKILYQSNPCPEPTGTRQARRNRRRRWRARQRQIREISERILTSCLGRPPEPVTLQLPPLERLTLNCSEDCGTSGEKGEGSPQISLESSTILGTGTKE

SEQ ID NO: 230 - protein, 107 aa, Human immunodeficiency virus type 1
  isolate=92RW009.6; gene=rev
MAGRSGDSDETLLQAVKIIKILYQSNPYPKPEGTRQARRNRRRRWRARQRQIHSISERILSTCLGRPTEPVPFQLPPIERLTIDCSEDGGTSGTQQSQGTTEGVGNP

SEQ ID NO: 231 - protein, 123 aa, Human immunodeficiency virus type 1
  isolate=92NG003.1; gene=rev
MAGRSGDADEELLRVTRIIKILYQSNPYPPPEGTRQARKNRRRRWRARQRQISALSERILSTCLGRPAEPVPLQLPPIERLSLDCSEDSRTPETQQSPGTETGVGGPQISVESPVVLGSGTKE

SEQ ID NO: 232 - protein, 116 aa, Human immunodeficiency virus type 1
  isolate=93BR029.4; gene=rev
MAGRSGDSDTELLKAVSYIKILYQSNPLPKPKGTRQARRNRRRRWRARQRQIREISERILSSCLGRPEEPVPLQLPPLERLHINCSEDCGQGTEEGVGSPQTSGESRAVLESGTKE

SEQ ID NO: 233 - protein, 117 aa, Human immunodeficiency virus type 1
  isolate=94CF032.3; gene=rev
MAGRSGNIDEDLFKAARAIKILYQSNPYPNNPTGTRQARRNRRRRWRARQKQIHSLSERILATYLGRPAEPVPLQLPPLEKLTLNCSEDCGTSGDKGVGSPQVSVELPAVLGTGAKE

SEQ ID NO: 234 - protein, 107 aa, Human immunodeficiency virus type 1
  isolate=96ZM651.8; gene=rev
MAGRSGDSDAALLLAARTIKILYQSNPYPEPKGTRQARKNRRRRWRARQREIRAISERILSTCLGRPTEPVPLQLPPIERLHIGDSESGGASETQQSQGTTEGVGSP

SEQ ID NO: 235 - protein, 96 aa, Human immunodeficiency virus type 1
  isolate=96ZM751.3; gene=rev
MAGRSGDNDEALLQAVRIIKILYQSNPYPNPEGTRQARKNRRRRWRARQRQINSISERILSTCLGRPPEPVPFQLPPLERLHIDCSEGTTEGVGNS

SEQ ID NO: 236 - protein, 123 aa, Human immunodeficiency virus type 1
  isolate=94CY017.41; gene=rev
TAGRSDDPDESLLQAIRTIKILYQSNPYPKPRGSRQAQRNRRRRWRARQRQIDSISERVLRTCLGRPTEPVPLQLPPLERLHIDCSEDCGTSGTLQSQGTETGVGRSQESVESSVILGSGTEE

SEQ ID NO: 237 - protein, 107 aa, Human immunodeficiency virus type 1
  isolate=94IN476; gene=rev
MAGRSGDSDAALLQAVRIIKILYQSNPYPRPEGTRQAQRNRRRRWRARQRQIHSISERILSTCLGRSTEPVPLQLPPIERLHIGCSESGGTSGTQQSQGTTEGVGSP

SEQ ID NO: 238 - protein, 81 aa, Human immunodeficiency virus type 1
  isolate=93BR020.1; gene=vpu
MSNLLAIGIAALIVALIITIVVWTIAYIEYKKLVRQRKINRLYKRISERAEDSGNESEGDAEELAALGEVGPFIPGDINNL

SEQ ID NO: 239 - protein, 78 aa, Human immunodeficiency virus type 1
  Xaa=unknown 8: isolate=92NG083.2; gene=vpu
MQALEISXLIVAFIAATIVWSIVFIEYRKIRKQKKIEKLLDRIRERAEDSGNESEGDTEELATLMEMGDFDPWVGNNL

SEQ ID NO: 240 - protein, 80 aa, Human immunodeficiency virus type 1
  isolate=90CF056.1; gene=vpu
MYILGLGIGALVVTFIIAVIVWTIVYIEYKKLVRQKKIDRLIERIGERAEDSGNESDGDTEELSKLMEMGHLNLGYVADL

SEQ ID NO: 241 - protein, 81 aa, Human immunodeficiency virus type 1
  isolate=92RW009.6; gene=vpu
MTSLEIYAIVALIVALIIVIVVWTLAGIEYKKLLKQRKIDRLIKKIRERAEDSGNESDGDIDELSKLVGVGNYDLGDVNNL

SEQ ID NO: 242 - protein, 76 aa, Human immunodeficiency virus type 1
  Xaa=unknown 26: isolate=92NG003.1; gene=vpu
MQSLEIAAIAGLVVAAIAAIVVWTIXKIKKQEKIDRLLDRIRERAEDSGNESEGDTEELATLVDMVDFDPWVGDNL

SEQ ID NO: 243 - protein, 81 aa, Human immunodeficiency virus type 1
  isolate=93BR029.4; gene=vpu
MSYLLVIGLAALIAALIIAIVVWTIAYIEYRELVRQRKINRLYKRIRERAEDSGNESEGDAEELAALGEMGPFIPGDIDNL

SEQ ID NO: 244 - protein, 81 aa, Human immunodeficiency virus type 1
  isolate=94CY032.3; gene=vpu
MLFWEIWAIVGLVVALIIVIVVWTLVFIEYKKLRRQRRIDSLYNRIRERAEDSGNESDGDAEELSTLVGMGNFDPWVGDNL

SEQ ID NO: 245 - protein, 86 aa, Human immunodeficiency virus type 1
  isolate=96ZM651.8; gene=vpu
MLDLLARVNYRVGVGALIVALLIAIVVWTIAYIEYRKLLRQRKIDWLIKRIRERAEDSGNESEGDTEELATMVDMGHLRLLDVNDL

SEQ ID NO: 246 - protein, 86 aa, Human immunodeficiency virus type 1
  isolate=96ZM751.3; gene=vpu
MLNLEARVDYRIGVGALIAALIIAIAVWIIVYIEYRKLSRQRKIDRLIKRIRERAEDSGNESEGDNEELATMVDMGHLRLLDAIDV

SEQ ID NO: 247 - protein, 81 aa, Human immunodeficiency virus type 1
  isolate=94CY017.41; gene=vpu
MLPLVILAIVGLIVALILAIVVWTIVFIEYKKIKKQRKIDWLIKRISERAEDSGNESDGDTEELSALVERGHLDFGDVNNV

SEQ ID NO: 248 - protein, 86 aa, Human immunodeficiency virus type 1
  isolate=94IN476.104; gene=vpu
MVNLLERVDYRLGVGALIVALILAIIVWTIAYLEYRKLLRQRKINRLIERIRERVEDSGNESEGDTEELSTLVDMGNLRLLDANDL

SEQ ID NO: 249 - protein, 846 aa, Human immunodeficiency virus type 1
  isolate=93BR20.1; gene=env
MRVRGMQRNWQHLGKWGLLFLGTLIICNAAENLWVTVYYGVPVWKEATTTLFCASDAKSYEKEAHNVWATHACVPTDPNPQEVVLENVTERFNMWENNMVEQMHTDIISLWDQSLKPCVKLTPLCVTLDCRNIATNGTNDTIAINDTLKEDPEAIQNCSFNTTTEIRDKQLKVHALFYKLDIVQINKDDNRTYRLINCDASTITQACPKVSWDPIPIHYCAPAGYAILKCNEKNFTGTGSCKNVSTVQCTHGIKPVVSTQLLLNGSLAEGEIVIRSQNISDNAKTIIVHLNESVQINCTRPNNNTRKRISLGPGRVFYTTGEIIGDIRKAHCNVSGTQWRNTLAKVKAKLGSYFPNATIKFNSSSGGDLEITRHNFNCMGEFFYCNTDELFNDTKFNDTGFNGTITLPCRIKQIVNMWQEVGRAMYANPIAGNITCNSNITGLLLTRDGGLNSTNETFRPGGGNMKDNWRSELYKYKVVEIEPLGVAPTKAKRQVVKRERRAVGLGALFLGFLGAAGSTMGAASITLTVQARQLLSGIVQQQSNLLRAIEAQQHLLQLTVWGIKQLQARVLAVERYLKDQQLLGLWGCSGKLICTTNVPWNSSWSNKSLEEIWGNMTWMEWEKEVSNYSKEIYRLIEDSQNQQEKNEQELLALDKWASLWNWFDITQWLWYIKIFIMIVGGLIGLRIVFTVLSIVNRVRKGYSPLSFQTHIPSPREPDRPEGIEEGGGEQGKDRSVRLVTGFLALAWDDLRNLCLFSYRHLRDFILIAARIVDRGLKRGWEALKYLGNLTQYWGQELKNSAISLLNATAIAVAEWTDRVIEALQRAGRAILNIPRRIRQGLERALL

SEQ ID NO: 250 - protein, 849 aa, Human immunodeficiency virus type 1
  isolate=92NG083.2; gene=env
MRVKGIQRNWQHLWKWGTLILGLVIICSASDNLWVTVYYGVPVWEDADTPLFCASDAKSYSSEKHNVWATHACVPTDPNPQEIAIENVTENFNMWKNNMVEQMQEDIISLWEESLKPCVKLTPLCITLNCTNVNSANHTEANNTVENKEEIKNCSFKITTERGGKKKEEYALFYKLDVVPISNGNKTSYRLIHCNVSTIKQACPKVNFDPIPIHYCAPAGFAILKCRDKEYNGTGPCKNVSTVQCTHGIKPVVSTQLLLNGSLAEEDIRIRSENFTDNTKVIIVQLNNSIEINCIRPNNNTRKSIPIGPGQAFYATGDIIGDIRQAHCNVSRIKWREMLKNVTAQLRKIYNNKNITFNSSAGGDLEITTHSFNCRGEFFYCNTSGLFNNNISNINNETITLPCKIKQIVRMWQKVGQAMYALPIAGNLVCKSNITGLILTRDGGNNNDSTEETFRPGGGDMRDNWRSELYKYKTVKIKSLGVAPTRARRRVVEREKRAVGLGAVFLGFLGAAGSTMGAASITLTAQVRQLLSGIVQQQSNLLRAIEAQQHLLQLTVWGIKQLQSRVLAIERYLKDQQLLGIWGCSGKLICTTNVPWNTSWSNKSYNEIWDNMTWLEWEREIHNYTQHIYSLIEESQNQQEKNEQDLLALDKWASLWNWFDISNWLWYIRIFIMIVGGLIGLRIVFAVLSIVNRVRQGYSPLSFQTLTHHQREPDRLGKTEEGGGEQDRDRSTRLVSGFLALAWDDLRSLCLFSYHRLRDLVLIAARTVELLGRSSLKGLRLGWEGLKYLWNLLLYWGRELKNSAINLLDTIAIATANGTDRVIEVAQRAYRAILNVPTRIRQGLERALL

SEQ ID NO: 251 - protein, 845 aa, Human immunodeficiency virus type 1
  isolate=90CF056.1; gene=env
METQRNYPSLWRWGTLILGMLLICSAAQNLWVTVYYGVPVWKEAKTTLFCASDAKAYETEKHNVWATHACVPTDPNPQEMVMENVTESFNMWENNMVEQMHTDIISLWDQSLKPCVKLTPLCVTLNCTNVRNNTSNSTSSMEAGGELTNCSFNVTTVLRDKQQKVHALFYRLDVVPIDNNSTQYRLINCNTSVITQACPKVSFEPIPIHYCAPAGFAILKCNNKTFNGTGLCTNVSTVQCTHGIRPVVSTQLLLNGSLAEEQIIIRTKNISDNTKNIIVQLKTPVNITCTRPNNNTRTSIHLGPGRAFYATGDIIGDIRQAHCNISRTDWNKTLHQVVTQLGIHLNNRTISFKPNSGGDMEVRTHSFNCRGEFFYCNTSGLFNSSWEMHTNYTSNDTKGNENITLPCRIKQIVNMWQRVGRAMYAPPIQGNIMCVSNITGLILTIDEGNASAENYTFRPGGGDMRDNWRSELYKYKVVKIEPLGIAPTKTRRRVVEREKRAVGMGASFLGFLGAAGSTMGAASITLTVQARQLLSGIVQQQSNLLRAIQARQHMLQLTVWGIKQLQARVLAVERYLRDQQLLGIWGCSGKLICTTNVPWNSSWSNKSQSEIWDNMTWMEWDKQISNYTEEIYRLLEVSQTQQEKNEQDLLALDKWASLWTWFDISHWLWYIKIFIMIVGGLIGLRIIFAVLSIVNRVRQGYSPLSFQTLVPNPRGPDRPEGTEEGGGEQDRDRSVRLVNGFLPVVWDDLRSLSLFSYRLLRDLLLIVVRTVELLGRRGREALKYLWNLLQYWGQELKNSAIDLLNTTAIAVAEGTDGIIVIVQRAWRAILHIPRRIRQGFERSLL

SEQ ID NO: 252 - protein, 860 aa, Human immunodeficiency virus type 1
  isolate=92RW009.6; gene=env
MRVMGTLMNYQNLWGWGTMILGMLTICSAANNLWVTVYYGVPVWKDAETTLFCASDAKAYDPEKHNVWATHACVPIDPDPQEIHLENVTEEFNMWKNNMVEQMHTDIISLWDQSLKPCVKLTPLCVTLECNNITNVNNTVNITDDMKGEIKNCSFNMTTELRDKKQRVYSLFYRLDIVQINSNSNNSSHNQYRLINCNTSAITQACPKVSFEPIPINYCAPAGFAILKCKDKKFNGTGPCKNVSTVQCTHGIKPVVSTQLLLNGSLAEEEIIIRSENITNNAKTIIVQLNETVQINCSRPNNNTRKSVHIGPGQAFYATGDVIGDIRQAYCTVNGTKWNRTLQKVAEKLSHYFENITTIIFKNSSGGDLEITTHSFNCGGEFFYCNTSGLFNSTWSKRNGTWQSNGTELNITLPCRIKQIINMWQRTGQAMYAPPIQGVISCVSNITGLLLTRDGGNNNTTTETFRPGGGDMRDNWRSELYKYKVVKIEPLGVAPTRAKRRVVEREKRAVGLGAVFIGFLGAAGSTMGAASITLTVQARQLLSGIVQQQSNLLRAIEAQQHLLKLTVWGIKQLQARVLALERYLRDQQLLGIWGCSGKLICTTNVPWNSSWSNKTQQEIWDNMTWQQWDKEIGNYTQIIYSLIEESQNQQEKNEQDLLALDKWANLWNWFDISNWLWYIKIFIMIVGGLIGLRIIFAVLSIVNRVRQGYSPLSFQTLIPNPRGPDRLGGIEEEGGEQDRGRSIRLVSGFLALAWDDLRSLCLFSYHRLRDLLLIAARTVELLGRSSLRGLQRGWETLKYLGNLVQYWGLELKRSAINLLDTTAIVVAEGTDRIIELIQRISRAIYNIPSRIRQGFEAALQ

SEQ ID NO: 253 - protein, 845 aa, Human immunodeficiency virus type 1
  isolate=92NG003.1; gene=env
MRVKGTQRNWQHLWTWWTLILGLVIICSASNNLWVTVYYGVPVWEDADTPLFCASDAKAYSTERHNVWATHACVPTDPNPQEITLENVTETFNMWKNNMVEQMHEDIISLWDESLKPCVKLTPLCVTLNCTNVNCNSNVTSTGNSAGTNATCNIEEANNLKNCSFNITTEIRDKKKTEYALFYRLDVVPIDGNNNVSNNYRLINCNVSTIKQACPKVSFDPLPIHYCAPAGFAILKCRGKNFTGTGQCKNVSSVQCTHGIKPVVSTQLLLNGSLAEGEIVIRSENLTDNAKVIIVQLNKTIGINCTRPNNNTRKSIRIGPGQAFYATGEIIGQEWQEMLQKVQAQLEQVFNKSITFNSSAGGDLEITTHSFNCRGEFFYCNTSGLFNESGGNDTTITLPCKIKQIVRMWQRVGQAMYAPPIAGDITCRSNITGLLLTRDGGVNNTGNETFRPGGGDMRDNWRSELYKYKIVKIKPLGIAPTKARRRVVERGKRAVGLGAVFLGFLGAAGSTMGAGSITLTVQVRQLLSGIVQQQSNLLRAIEAQQHLLQLTVWGIKQLQARVLAVERYLKDQQLLGIWGCSGKLICTTNVPWNTSWSNKSYEEIWDNMTWIQWEREVSNYTQQIYSLIEESQNQQEKNEQDLLALDKWASLWNWFDITKWLWYIKIFIMIVGGLIGLRIVFAVLSIVNRVRQGYSPLSFQTLTHHQREPDRPERIEEGGGEQDRDRSVRLVSGFLALAWDDLRNLCLFSYHRLRDLVLIAARTAELLRRSSLQGLRLGWEGLKYLWNLLLYWGRELKNSAINLIDTIAIAVANWTDRVIEVAQGACRAILNIPRRIRQGLERALL

SEQ ID NO: 254 - protein, 842 aa, Human immunodeficiency virus type 1
  isolate=93BR029.4; gene=env
MRVRGMQRNWQHLGKWGLLFLGILIICNAENLWVTVYYGVPVWKEATTTLFCASDAKAYEKEAHNVWATHACVPTDPNPQEVVLENVTENFDMWKNNMVEQMHTDIISLWDQSLKPCVKLTPLCVTLRCSNATTNSTQNDTLKEEPGAIQNCSFNMTTEVRDKQLKVHALFYRLDIVPISNDNSSNDNSSREYRLINCNTSTLTQACPKVSWDPIPIHYCAPAGYAILKCNDKKFNGTGPCRNVSTVQCTHGIKPVVSTQLLLNGSLAEKDIIIRSQNISDNAKTIIVQLNVSVPINCTRPNNNTRKSIPIGPGRAFYTTGEIIGDIRKAHCNVSGTKWNETLEKVRAKLKPHFPNATIKFNSSSGGDLEITMHSFNCRGEFFYCNTSGLFNDTVDNGTITLPCRIKQIVNMWQEVGRAMYAAPIAGNITCSSNITGLLLTRDGGQNNQTEETFRPGGGNMKDNWRSELYKYKVVEIEPLGVAPTKAKRQVVKREKRAVGMGALFLGFLGAAGSTMGAASITLTAQARQLLSGIVQQQNNLLRAIEAQQHLLQLTVWGIKQLQARILAVERYLKDQQLLGLWGCSGKLICTTDVPWNSSWSNKSQEKIWGNMTWMEWEKEISNYSNEIYRLIEESQNQQEKNEQELLALDKWASLWNWFDISKWLWYIKIFIMIVGGLIGLRIVFAVLSIVNRVRKGYSPLSLQTRFPSPREPDRPEGIEEGGGEPGKDRSVRLVNGFLALVWDDLRNLCLFSYRHLRDFILIAARIVDRGLKRGWEALKLLGNLALYWSQELKNSAISLLNTTAIVVAEGTDRVIEALQRAGRAVLNVPRRIRQGLERALL

SEQ ID NO: 255 - protein, 855 aa, Human immunodeficiency virus type 1
  isolate=94CY032.3; gene=env
MRVMGMQRNYPHLWEWGTLILGLVIICSASNNLWVTVYYGVPVWRDAETTLFCASEAKAYEKEVHNIWATHACVPTDPNPQEVALINVTENFNMWKNDMVEQMHEDIISLWNEGLKPCAKLTSLCVTFTCINATTTNSTNGTVIKEGIKNCSFDITTEIRDKKKKEYALFYRIDIVPINARVPINGSNRNNSTEEYMLINCNASTIKQACPKVSFEPIPIHYCAPAGFAILKCNEKNFTGLGPCTNVSSVRCTHGIKPVVSTQLLLNGSLATEEVVIRSKNITDNTKNIIVQLAKAVKINCTRPGNNTRKSVHIGPGLTWYATGEIIGDIRQAHCNISGNDWNDTLKVISEELKRLFPNKTIKFAPPVGGDLEITTHSFNCKGEFFYCNTTPLFNSTHMQNGTNITSTDSTNSTITLQCRLKQFVRMWQEVGQAMYASPIAGSINCSSDITGIILTRDGGTNNTEIFRPGGGDMRDNWRSELYKYKVVKIEPIGVAPNKARRRVVQREKAVGIGAMFLGFLGAAGSTMGAASMTLTVQARQLLSGIVQQQSNLLRAIEAQQHLLRLTVWGIKQLQARVLALESYLKDQQLLGIWGCSGKLICTTNVPWNSSWSNKSYNDIWDNMTWLQWDKEINNYTQIIYGLLEESQNQQEKNEQDLLALDKWASLWNWFSITKWLWYIKIFIMIVGGLIGLRIIFAVLSIVNRVRQGYSPLSLQTLIPTTQRGLDRPGGTEEEGGEQDRSRSIRLVNGFLPLIWDDLRNLCLFSYRHLRNLLLIVARTVELLGIRGWEALKYLWNFLLYWGQELKNSAINLFNTTAIAVAEGTDRIIEAVQRACRAICNIPRRIRQGLERALL

SEQ ID NO: 256 - protein, 868 aa, Human immunodeficiency virus type 1
  isolate=96ZM651.8; gene=env
MRVREILRNWQRWWTWGILGFWMLMICNVWGNLWVTVYYGVPVWKEAKTTLFCASDAKSYEKEVHNVWATHACVPTDPNPQEIVLGNVTENFNMWKNDMVDQMHEDIISLWDQSLKPCVKLTPLCVTLNCTEVNVTRNVNNSVVNNTTNVNNSMNGDMKNCSFNITTELKDKKKNVYALFYKLDIVSLNETDDSETGNSSKYYRLINCNTSALTQACPKVSFDPIPIHYCAPAGYAILKCNNKTFNGTGPCHNVSTVQCTHGIKPVVSTQLLLNGSLAEEGIIIRSENLTNNVKTIIVHLNRSIEIVCVRPNNNTRQSIRIGPGQTFYATGDIIGDIRQAHCNISRTNWTKTLREVRNKLREHFPNKNITFKPSSGGDLEITTHSFNCRGEFFYCNTSGLFSINYTENNTDGTPITLPCRIRQIINMWQEVGRAMYAPPIEGNIACKSDITGLLLVRDGGSTNDSTNNNTEIFRPAGGDMRDNWRSELYKYKVVEIKPLGIAPTEAKRRVVEREKRAVGIGAVFLGFLGAAGSTMGAASITLTAQARQVLSGIVQQQSNLLRAIEAQQHLLQLTVWGIKQLQTRVLAIERYLKDQQLLGLWGCSGKLICTTAVPWNISWSNKSKTDIWDNMTWMQWDREISNYTNTIYRLLEDSQSQQEQNEKDLLALDSWNNLWNWFDITKWLWYIKIFIMIVGGLIGLRIIFAVLSIVNRVRQGYSPLSFQTLIPNPREPDRPGRIEEEGGEQDKERSVRLVSGFLALAWDDLRSLCLFSYHRLRDFILVTARAVELLRRSSLKGLQRGWEALKYLGSLVQYWGLELKKSAISLLDTIAIAVAEGTDRIIELIQGICRAIRNVPRRIRQGFETALL

SEQ ID NO: 257 - protein, 846 aa, Human immunodeficiency virus type 1
  isolate=96ZM751.3; gene=env
MRVKGIMRNWQQWWIWGILGFWMLLMCNAMGKLWVTVYYGVPVWKEAKTTLFCASDAKAYETEVHNVWATHACVPTDPNPQEMVLENVTEKFNMWENNMVDQMHEDIISLWDQSLKPCVKLTPLCVTLNCTANITNNANITNNANITNYNNETDMRNCSFNITTELRDKRRQVDALFYKLDIVPINENSSEYRLINCNTSAITQACPKVTFDPIPIHYCAPAGYAILKCNNKTFNGTGPCNNVSTVQCTHGIKPVVSTQLLLNGSLAEEEIIIRSKNMTDNAKIIIVHLNESVEIVCTRPNNNTRKSVRIGPGQTFYATGEIIGNIRQAYCNISEGKWNNTLQRVGEKLRKYFPNKTISFAPSSGGDLEITTHSFNCRGEFFYCNTSKLFNGTFNGTNTSNDRSNSTITLQCRIKQITNMWQGVGQAMYAPPIKGNITCKSNITGLLLTRDGGTNDTETPETFRPGGGDMKDNWRSELYKYKVVEIKPLGVAPTKARRRVVEREKRAVGIGAVFLGFLGAAGSTMGAASITLTVQVRQLLSGIVQQQSNLLRAIEAQQHMLQLTVWGIKQLQARVLAIERYLKDQQLLGIWGCSGKLICTTAVPWNSSWSNKSEREIWDNMTWMQWDREINNYTETIYRLLEVSQNQQENNERDLLALDSKNLWNWFNITNWLWYIKIFIMIIGGLIGLRIIFAVLSIVNRVRQGYSPLSLQTLIPTPREPDRLGRIEEEGGEQDRDRSIRLVNGFLALVWDDLRSLCLFSYHRLRDFILIAARGLQRGWETLKYLGSLVQYWGLELKKSAISLLDTIAIAVAEGTDRIIELTQRICRAIRNVPRRIRQGFEAALQ

SEQ ID NO: 258 - protein, 865 aa, Human immunodeficiency virus type 1
  isolate=94CY017.41; gene=env
MRVMGTQRNYQHLWRGGILILGMLIMCKATDLWVTVYYGVPVWKDADTILFCASDAKAYDTEVHNVWATHACVPTDPNPQEINLENVTENFNMWKNNMVEQMQEDIISLWDQSLKPCVKLTPLCVILNCSNANTSTHSNSSSTQSPINEEIKNCSYNTTTILRDKTQKVYSLFYRLDVVQLDESENKNTSGSNTLYRLINCNTSTITQACPKVTFEPIPIHYCAPAGFAILKCKDPRFNGTGSCKNVSSVQCTHGIKPVASTQLLLNGSLAEGGKIMIRSENITNNAKNIIVQFTKPVLITCIRPNNNTRKSIRFGPGQAFYTNEIIGDIRQAHCNINKTLWNDTLQKVAEQLREKFPKKTIIFTNSSGGDPEITTLSFNCAGEFFYCNTTGLFNGTWWNNGTWNGPYTPNNTNGSIILPCRIKQIINMWQRVGRAMYAPPIAGIIKCTSNITGIILTRDGGNNGTNETFRPGGGDMRDNWRSELYKYKVVKLEPLGVAPTRAKRRVVEREKRAVGLGAVFLGFLGAAGSTMGAASLTLTVQARQLLSGIVQQQSNLLQAIEAQQHLLKLTVWGIKQLQARVLAVERYLKDQQLLGIWGCSGKLICATTVPWNTSWSNKSQDEIWDNMTWLQWDKEISNYTNIIYRLLEESQNQQEKNEQDLLALDKWADLWSWFNISHWLWYIRIFIMIVGGLIGLRIVFAIITVVNRVRQGYSPVSFQIPTPSPEGPDRPRGTEEGGGEQGRDRSIRLVNGFFALAWDDLRSLCLFSYHRLRDCILIAARTVELLGHCSLKGLRLGWEGLKNLWNLLLYWGRELKNSAISLFDTIAVAVAEWTDRVIEIGQRAFRAILNIPRRIRQGLERALL

SEQ ID NO: 259 - protein, 857 aa, Human immunodeficiency virus type 1
  isolate=94IN476.104; gene=env
MRVRGILRNCQHWWIWGILGFWMLMIYNVVGNLWVTVYYGVPVWKEAKTTLFCASDAKAYEKEVHNIWATHACVPTDPNPQEMDLVNVTENFNMWKNDMVDQMHEDVISLWDQSLKPCVKLTPLCVTLNCSKVTNNATYNNTDDIKNCSFNATTEIRDKKRKEYALFYRLDIVPLNENKNSSSNYSEYILINCNTSTITQACPKVSFDPIPIHYCAPAGFAILKCKDETFNGTGPCKEVSTVQCTHGIKPVVSTQLLLNGSTAEKEIITRSENITDNAKTIIVHLNESIKIVCTRPNNNTRKSIRIGPGQAFYATNGIIGDIRQAHCNISESNWTKTLQEVGKKLAKHFPNKTISFNQSSGGDLEIVTHSFNCGGEFFYCNTSRLFNGTYNGTDMPTYNGTNSSSDIIMLPCRIRQFINIWQKVGRAMYAPPIEGNITCESNITGLLLVRDGGDTNSSTEIFRPGGGDMRDNWRSELYKYKVVEIKPLGIAPTEAKRRVVEREKRAVGIGAVFLGFLGVAGSTMGAASMTLTVQARQLLSGIVQQQSNLLKAIEAQQHMLQLTVWGIKQLQTRVLAIERYLKDQQLLGIWGCSGKVICPTAVPWNSSWSNKSKDDIWNNMTWMQWDKEISNYTNTIYRLLEESQIQQEQNGKDLLALDSWQNLWNWFSITKWLWYIKIFIIIVGGLIGLRIIFAVLSIVNRVRQGYSPLSLQTLTPDPREPDRLRGIEEEGGEQDKDRSIRLVNGFLALAWDDLRSLCLFSCHRLRDFILVAARAVELLGRSSLRGLQRGWEALKYLGSLVQYWGLELKKSAISLLDTIAITIAEGTDRIIEFTQRICRAIRNIPRRIRQGFEAALL

SEQ ID NO: 260 - protein, 208 aa, Human immunodeficiency virus type 1
  isolate=93BR020.1; gene=nef
MGGKWSKSSIVGWPAIRERMRRTPPTPPAAEGVGAVSQDLERRGAITSSNTRANNPDLAWLEAQEEDEVGFPVRPQVPLRPMTYKGAVDLSHFLKEKGGLEGLIYSKRRQEILDLWVYHTQGYFPDWQNYTPGPGIRYPLTMGWCFKLVPVDPEEVEKANEGENNCLLHPMSQHGMEDEDKEVLKWEFDSRLALRHIARERHPEYYQD

SEQ ID NO: 261 - protein, 207 aa, Human immunodeficiency virus type 1
  isolate=92NG083.2; gene=nef
MGGKWSKSSIVGWPQIRERIRQTPVAAEGVGAVSQDLARHGAITSSNTATNNPDCAWLEAQEEDSDVGFPVRPQVPLRPMTYKAAFDLSFFLKEKGGLDGLIYSKRRQDILDLWVYNTQGFFPDWQNYTPGPGTRLPLTFGWCFKLVPMDPAEIEEANKGENISLLHPICQHGMEDEDREVLVWRFNSSLARRHLARELHPEYYKDC

SEQ ID NO: 262 - protein, 206 aa, Human immunodeficiency virus type 1
  isolate=90CF056.1; gene=nef
MGGKWSKSRMGGWSTIRERMRRAEPVAEGVGAVSRDLDRRGAVTINNTASTNRDAAWLEAQEDGEEVGFPVRPQVPLRPMTYKGAFDLSHFLKEKGGLDGLIYSKQRQDILDLWVYNTQGYFPDWQNYTPGPGERFPLTFGWCFKLVPVNPQEVEQANEGENNSLLHPMSLHGMEDDGREVLMWKFDSRLALTHLARVKHPEYKDC

SEQ ID NO: 263 - protein, 207 aa, Human immunodeficiency virus type 1
  isolate=92RW009.6; gene=nef
MGSKWSKCSPVGWPAVRERLRQTEPAAEGVGAASQDLDKYGALTSSNTPSNNADCAWLAAQEEENEVGFPVRPQVPLRPMTYKAAVDLSFFLKEKGGLEGLIYSKKRQDILDLWVYNTQGYFPDWQNYTPGPGVRYPLTFGWCYKLVPVDPREVEEANEGEDNCLLHPLSQHGMEDEDREVLKWKFDSHLAHRHMARELHPEYYKDC

SEQ ID NO: 264 - protein, 206 aa, Human immunodeficiency virus type 1
  isolate=92NG003.1; gene=nef
IGGKWSKSSIVGWPAVRERIRQTPPAEGVGAAPQDLARHGAITSSNTAQTNPDCAWLEAQQENSEVGFPVRQQVPLRPMTYKAAFDLSFFLKEKGGLDGLIYSKKRQDILDLWVYNTQGYFPDWQNYTPGPGTRFPLTFRWCFKLVPMDPAEIEEANKGENNSLLHPICQHGLEDADREVLVWRFDSSLARRHIAREQHPEYYKDC

SEQ ID NO: 265 - protein, 206 aa, Human immunodeficiency virus type 1
  isolate=93BR029.4; gene=nef
MGSKWSKSSIVGWPAIRERLRQTPPAAEGVGAVSQDLERRGAITSSNTGANNPDLAWLEAQEEEEVGFPVRPQVPLRPMTYKGALDLSHFLKEKGGLEGLIYSKKRQEILDLWVYHTQGYFPDWQNYTPGPGTRYPLTLGWCFKLVPVDPEEVEKANEGENNCLLHPMSQHGMEDEDREILQWRFDSRLAFHHMARELHPEYYKDC

SEQ ID NO: 266 - protein, 219 aa, Human immunodeficiency virus type 1
  isolate=94CY032.3; gene=nef
MGGKWSKSSIVGWPEIRERMRRARAEPERMRRAQAEPAAAGVGAVSQDLDKHGAITINNTAATNPDKTWLEAQEEEEEVGFPVRPQVPLRPMTFKGALDLSHFLKEKGGLDGLIYSKKRQEILDLWVYHTQGFFPDWDNYTPGPGERFPLCFGWCFKLVPVDPQEVEEATEGENTCLLHPISQHGMEDEEREVLKWKFDSRLAYKHVARELHPEFYKDC

SEQ ID NO: 267 - protein, 206 aa, Human immunodeficiency virus type 1
  isolate=96ZM651.8; gene=nef
MGGKWSKSSIVGWPAVRERIRRTEPAAEGVGAASQDLDKYGALTSSNTSTTNAACAWLEAQEEEEVGFPVRPQVPLRPMTYKAAVDLSFFLKEKGGLEGLIYSKKRQEILDLWVYHTQGFFPDWQNYTPGPGVRYPLTFGWCFKLVPVDPGEVEEANEGENNCLLHPMSQQGMDDDHREVLKWKFDSHLAHKHMARELHPEYYKDC

SEQ ID NO: 268 - protein, 207 aa, Human immunodeficiency virus type 1
  isolate=96ZM751.3; gene=nef
MGGKWSKRSIVGWPKVRERIARTDPAAEGVGAASQDLDKYGALTSSNTSTNNADCAWLEAQEEEGEVGFPVRPQVPLRPMTYKSAFDLSFFLKEKGGLDGLIYCKKRQEILDLWVYHTQGYFPDWQNYTPGPGIRYPLTFGWCYKLVPVDPREVEEANEGEDNCLLHPISQHGIEDEDREVLRWKFDSSLARRHMARELHPEYYKDC

SEQ ID NO: 269 - protein, 217 aa, Human immunodeficiency virus type 1
  isolate=94CY017.41; gene=nef
MGGKWSKRSIPGWPAIRERMRRTPPTAQRTEAVSPAAPGVGAVSQDLATHGAVTSSNTAATNPDCAWVEAQEEESEVGFPVRPQVPLRPMTFKGAFDLSFFLKEKGGLDGLIYSQKRQDILDMWVYHTQGYFPDWQNYTPGPGIRYPLTFGWCFKLVPVEPSEVEEATQGENNSLLHPICQHGVDDPEREVLRWEFDRSLARRHRARELHPEYYKDC

SEQ ID NO: 270 - protein, 207 aa, Human immunodeficiency virus type 1
  isolate=94IN476.104; gene=nef
MGSKMSKSRIVGWPEVRERMRRTEPAAEGVGAASQDLAKHGALTTSNTPSNNAAGAWLQAQEEEEEVGFPVRPQVPLRPMTYKGAFDLAFFLKEKGGLDGLIYSKKRHEILDLWVYNTQGYFPDWQNYTPGPGVRYPLTFGWCYKLVPVDPSVVEEANKGENNCLLHPMSQHGMDDEDGEVLKWQFDSSLARRHIARELHPEYYKDC

What is claimed is:

1. A nucleic acid comprising the nucleotide sequence of the genome of a non-subtype B HIV-1 virus, wherein said nucleotide sequence is SEQ ID NO:8.

2. The nucleic acid of claim 1, wherein said nucleic acid comprises the sequence of an LTR of said nucleic acid.

3. The nucleic acid of claim 1, wherein said nucleic acid encodes a polypeptide selected from the group consisting of Gag, Pol, Vif, Vpr, Env, Tat, Rev, Nef and Vpu, wherein the polypeptide is encoded by the genome of a non-subtype B HIV-1 virus 96ZM651.8, wherein the nucleotide sequence of said genome is SEQ ID NO:8.

4. A vector comprising a nucleic acid of claim 1.

5. An isolated cell comprising the vector of claim 4.

6. A nucleic acid comprising a sequence complementary to the sequence of a nucleic acid of any one of claim 1, 2 or 3.

* * * * *